(12) United States Patent
Goldfless et al.

(10) Patent No.: US 11,471,489 B2
(45) Date of Patent: Oct. 18, 2022

(54) T CELL RECEPTORS AND ENGINEERED CELLS EXPRESSING SAME

(71) Applicant: Juno Therapeutics, Inc., Seattle, WA (US)

(72) Inventors: Stephen Jacob Goldfless, Seattle, WA (US); Brian Belmont, Seattle, WA (US); Cameron Brandt, Seattle, WA (US); Alexandra Croft, Seattle, WA (US); David Jeffrey Huss, Seattle, WA (US)

(73) Assignee: Juno Therapeutics, Inc., Seattle, WA (US)

( * ) Notice: Subject to any disclaimer, the term of this patent is extended or adjusted under 35 U.S.C. 154(b) by 721 days.

(21) Appl. No.: 16/374,729

(22) Filed: Apr. 3, 2019

(65) Prior Publication Data

US 2019/0321401 A1    Oct. 24, 2019

Related U.S. Application Data

(60) Provisional application No. 62/739,145, filed on Sep. 28, 2018, provisional application No. 62/653,516, filed on Apr. 5, 2018.

(51) Int. Cl.
*A61K 35/17* (2015.01)
*A61P 35/00* (2006.01)
(Continued)

(52) U.S. Cl.
CPC .............. *A61K 35/17* (2013.01); *A61P 35/00* (2018.01); *C07K 14/025* (2013.01);
(Continued)

(58) Field of Classification Search
CPC ....... A61K 35/17; A61P 35/00; C07K 14/025; C07K 14/7051; C07K 16/084; C12N 15/86
See application file for complete search history.

(56) References Cited

U.S. PATENT DOCUMENTS 4,235,871 A    11/1980   Papahadjopoulos et al.
4,452,773 A     6/1984   Molday et al.
(Continued)

FOREIGN PATENT DOCUMENTS

AU    2004/308964    7/2005
CA       2551560    7/2005
(Continued)

OTHER PUBLICATIONS

US 8,252,592 B2, 08/2012, Sadelain et al. (withdrawn)
(Continued)

*Primary Examiner* — Kevin K Hill
*Assistant Examiner* — Anjeanette Roberts
(74) *Attorney, Agent, or Firm* — Morrison & Foerster LLP

(57) ABSTRACT

Provided herein are binding molecules, such as those that recognize or bind a peptide epitope of a cancer antigen, such as expressed on a cancer cell, including cells infected with human papilloma virus (HPV) or that contain HPV DNA sequences and/or those that recognize or bind a peptide epitope of HPV 16 E6 or E7, in the context of a major histocompatibility complex (MHC) molecule. Among the provided binding molecules are T cell receptors (TCRs) or antibodies, including antigen-binding fragments thereof, that bind or recognize such peptide epitopes. The present disclosure further relates to engineered cells comprising such binding molecules, e.g., TCRs or antibodies (and chimeric antigen receptors containing the antibodies), and uses thereof in adoptive cell therapy.

60 Claims, 16 Drawing Sheets

Specification includes a Sequence Listing.

(51) Int. Cl.
  *C07K 14/025* (2006.01)
  *C07K 14/725* (2006.01)
  *C07K 16/08* (2006.01)
  *C12N 15/86* (2006.01)

(52) U.S. Cl.
  CPC ........ *C07K 14/7051* (2013.01); *C07K 16/084* (2013.01); *C12N 15/86* (2013.01)

(56) References Cited

U.S. PATENT DOCUMENTS

| | | |
|---|---|---|
| 4,501,728 A | 2/1985 | Geho et al. |
| 4,690,915 A | 9/1987 | Rosenberg et al. |
| 4,777,239 A | 10/1988 | Schoolnik et al. |
| 4,795,698 A | 1/1989 | Owen et al. |
| 4,837,028 A | 6/1989 | Allen et al. |
| 5,019,369 A | 5/1991 | Presant et al. |
| 5,087,616 A | 2/1992 | Myers et al. |
| 5,200,084 A | 4/1993 | Liberti et al. |
| 5,219,740 A | 6/1993 | Miller et al. |
| 5,283,173 A | 2/1994 | Fields et al. |
| 5,468,614 A | 11/1995 | Fields et al. |
| 5,789,538 A | 8/1998 | Rebar et al. |
| 6,007,988 A | 12/1999 | Choo et al. |
| 6,013,453 A | 1/2000 | Choo et al. |
| 6,040,177 A | 3/2000 | Riddell et al. |
| 6,060,273 A | 5/2000 | Dirks et al. |
| 6,140,081 A | 10/2000 | Barbas et al. |
| 6,183,746 B1 | 2/2001 | Urban et al. |
| 6,207,453 B1 | 3/2001 | Maass et al. |
| 6,355,424 B1 | 3/2002 | Lorincz et al. |
| 6,410,319 B1 | 6/2002 | Raubitschek et al. |
| 6,451,995 B1 | 9/2002 | Cheung et al. |
| 6,453,242 B1 | 9/2002 | Eisenberg et al. |
| 6,534,261 B1 | 3/2003 | Cox et al. |
| 6,582,704 B2 | 6/2003 | Urban et al. |
| 6,602,684 B1 | 8/2003 | Umana et al. |
| 7,070,995 B2 | 7/2006 | Jensen et al. |
| 7,097,843 B2 | 8/2006 | Urban et al. |
| 7,189,513 B2 | 3/2007 | Khleif et al. |
| 7,265,209 B2 | 9/2007 | Jensen et al. |
| 7,354,762 B2 | 4/2008 | Jensen et al. |
| 7,399,467 B2 | 7/2008 | Lu et al. |
| 7,446,179 B2 | 11/2008 | Jensen et al. |
| 7,446,190 B2 | 11/2008 | Jensen et al. |
| 7,446,191 B2 | 11/2008 | Jensen et al. |
| 7,507,538 B2 | 3/2009 | Khleif et al. |
| 7,521,541 B2 | 4/2009 | Eigenbrot et al. |
| 7,569,664 B2 | 8/2009 | Jakobsen et al. |
| 7,855,275 B2 | 12/2010 | Eigenbrot et al. |
| 8,252,893 B2 | 8/2012 | Kim et al. |
| 8,324,353 B2 | 12/2012 | Jensen et al. |
| 8,389,282 B2 | 3/2013 | Sadelain et al. |
| 8,399,645 B2 | 3/2013 | Campana et al. |
| 8,497,118 B2 | 7/2013 | Jensen |
| 8,802,374 B2 | 8/2014 | Jensen et al. |
| 8,865,162 B2 | 10/2014 | Cheng et al. |
| 8,911,993 B2 | 12/2014 | June et al. |
| 8,956,828 B2 | 2/2015 | Bonini et al. |
| 8,968,995 B2 | 3/2015 | Cheng et al. |
| 9,228,007 B1* | 1/2016 | Kitchen ............... C12N 5/0636 |
| 9,273,283 B2 | 3/2016 | Sentman et al. |
| 2002/0131960 A1 | 9/2002 | Sadelain et al. |
| 2002/0164328 A1 | 11/2002 | Shinkawa et al. |
| 2003/0115614 A1 | 6/2003 | Kanda et al. |
| 2003/0157108 A1 | 8/2003 | Presta et al. |
| 2003/0170238 A1 | 9/2003 | Gruenberg et al. |
| 2004/0093621 A1 | 5/2004 | Shitara et al. |
| 2004/0109865 A1 | 6/2004 | Niwa et al. |
| 2004/0110282 A1 | 6/2004 | Kanda et al. |
| 2004/0110704 A1 | 6/2004 | Yamane et al. |
| 2004/0132140 A1 | 7/2004 | Satoh et al. |
| 2005/0123546 A1 | 6/2005 | Umana et al. |
| 2007/0116690 A1 | 5/2007 | Yang et al. |
| 2009/0047660 A1 | 2/2009 | Lu et al. |
| 2009/0117140 A1 | 5/2009 | Nakagawa et al. |
| 2010/0047805 A1 | 2/2010 | Wang et al. |
| 2010/0209904 A1 | 8/2010 | Lu et al. |
| 2011/0003380 A1 | 1/2011 | Miltenyi et al. |
| 2011/0158957 A1 | 6/2011 | Bonini et al. |
| 2011/0207221 A1 | 8/2011 | Cost et al. |
| 2011/0301073 A1 | 12/2011 | Gregory et al. |
| 2012/0164629 A1 | 6/2012 | Lu et al. |
| 2013/0149337 A1 | 6/2013 | Cooper et al. |
| 2013/0287748 A1 | 10/2013 | June et al. |
| 2014/0219975 A1 | 8/2014 | June et al. |
| 2014/0301990 A1 | 10/2014 | Gregory et al. |
| 2015/0056705 A1 | 2/2015 | Conway et al. |
| 2015/0093742 A1 | 4/2015 | Lu et al. |
| 2015/0164954 A1 | 6/2015 | Bonini et al. |
| 2015/0203817 A1 | 7/2015 | Galetto et al. |
| 2016/0083449 A1* | 3/2016 | Schmitt ............... A61K 38/2013 435/235.1 |
| 2016/0272999 A1 | 9/2016 | Duchateau et al. |
| 2017/0016025 A1 | 1/2017 | Poirot et al. |
| 2017/0016027 A1 | 1/2017 | Lee et al. |
| 2017/0088895 A1 | 3/2017 | Han et al. |
| 2017/0145070 A1 | 5/2017 | Hinrichs et al. |
| 2017/0211075 A1 | 7/2017 | Lee et al. |
| 2017/0290858 A1 | 10/2017 | Zhao et al. |
| 2017/0312350 A1* | 11/2017 | Maurer ............... A61P 35/02 |
| 2019/0225692 A1 | 7/2019 | Sissons et al. |
| 2021/0015869 A1 | 1/2021 | Burleigh et al. |
| 2021/0017249 A1 | 1/2021 | Sather et al. |
| 2021/0284709 A1 | 9/2021 | Brandt et al. |

FOREIGN PATENT DOCUMENTS

| | | |
|---|---|---|
| EP | 452342 | 10/1991 |
| EP | 1708745 | 4/2012 |
| EP | 2537416 | 12/2012 |
| JP | 2007-522108 | 8/2007 |
| WO | WO 1992/008796 | 5/1992 |
| WO | WO 1994/028143 | 12/1994 |
| WO | WO 1995/019431 | 7/1995 |
| WO | WO 1996/006166 | 2/1996 |
| WO | WO 1996/013593 | 5/1996 |
| WO | WO 1996/018105 | 6/1996 |
| WO | WO 1997/030087 | 8/1997 |
| WO | WO 1998/054311 | 3/1998 |
| WO | WO 1998/053057 | 11/1998 |
| WO | WO 1998/053058 | 11/1998 |
| WO | WO 1998/053059 | 11/1998 |
| WO | WO 1998/053060 | 11/1998 |
| WO | WO 1998/058964 | 12/1998 |
| WO | WO 1999/018129 | 4/1999 |
| WO | WO 1999/22764 | 5/1999 |
| WO | WO 1999/060120 | 11/1999 |
| WO | WO 2000/014257 | 3/2000 |
| WO | WO 2000/061739 | 10/2000 |
| WO | WO 2000/067761 | 11/2000 |
| WO | WO 2001/029246 | 4/2001 |
| WO | WO 2001/060970 | 8/2001 |
| WO | WO 2002/016536 | 2/2002 |
| WO | WO 2002/031140 | 4/2002 |
| WO | WO 2002/077012 | 10/2002 |
| WO | WO 2003/011878 | 2/2003 |
| WO | WO 2003/016496 | 2/2003 |
| WO | WO 2003/020763 | 3/2003 |
| WO | WO 2003/084570 | 10/2003 |
| WO | WO 2003/085107 | 10/2003 |
| WO | WO 2003/085119 | 10/2003 |
| WO | WO 2004/033685 | 4/2004 |
| WO | WO 2004/056312 | 7/2004 |
| WO | WO 2005/035586 | 4/2005 |
| WO | WO 2005/035778 | 4/2005 |
| WO | WO 2005/053742 | 6/2005 |
| WO | WO 2006/000830 | 1/2006 |
| WO | WO 2006/037960 | 4/2006 |
| WO | WO 2006/059529 | 6/2006 |
| WO | WO 2008/121420 | 10/2008 |
| WO | WO 2008/147187 | 12/2008 |
| WO | WO 2009/120022 | 1/2009 |
| WO | WO 2009/072003 | 6/2009 |

(56) References Cited

FOREIGN PATENT DOCUMENTS

| WO | WO 2009/148229 | 12/2009 |
|---|---|---|
| WO | WO 2009/148230 | 12/2009 |
| WO | WO 2010/033140 | 3/2010 |
| WO | WO 2010/123561 | 10/2010 |
| WO | WO 2011/044186 | 4/2011 |
| WO | WO 2011/101122 | 8/2011 |
| WO | WO 2012/048340 | 4/2012 |
| WO | WO 2012/048341 | 4/2012 |
| WO | WO 2012/036437 | 6/2012 |
| WO | WO 2012/129514 | 9/2012 |
| WO | WO 2013/037695 | 3/2013 |
| WO | WO 2013/071154 | 5/2013 |
| WO | WO 2013/123061 | 8/2013 |
| WO | WO 2013/126726 | 8/2013 |
| WO | WO 2013/166321 | 11/2013 |
| WO | WO 2013/169386 | 11/2013 |
| WO | WO 2014/031687 | 2/2014 |
| WO | WO 2014/055668 | 4/2014 |
| WO | WO 2014/096803 | 6/2014 |
| WO | WO 2014/134165 | 9/2014 |
| WO | WO 2014/191128 | 12/2014 |
| WO | WO 2015/009604 | 1/2015 |
| WO | WO 2015/009606 | 1/2015 |
| WO | WO 2015/010347 | 1/2015 |
| WO | WO 2015/018943 | 2/2015 |
| WO | WO 2015/066551 | 5/2015 |
| WO | WO 2015/136001 | 9/2015 |
| WO | WO 2015/143558 | 10/2015 |
| WO | WO 2015/161276 | 10/2015 |
| WO | WO 2015/184228 | 12/2015 |
| WO | WO 2016/016341 | 2/2016 |
| WO | WO 2016/044227 | 3/2016 |
| WO | WO 2016/069282 | 5/2016 |
| WO | WO 2016/069283 | 5/2016 |
| WO | WO 2016/146618 | 9/2016 |
| WO | WO 2017/070429 | 4/2017 |
| WO | WO 2017/093969 | 6/2017 |
| WO | WO 2017/193107 | 11/2017 |
| WO | WO 2018/005556 | 1/2018 |
| WO | WO 2018/005559 | 1/2018 |
| WO | WO 2018/067618 | 4/2018 |
| WO | WO 2019/005897 | 1/2019 |
| WO | WO 2019/070541 | 4/2019 |
| WO | WO 2019/195486 | 10/2019 |

OTHER PUBLICATIONS

U.S. Appl. No. 16/338,452, filed Mar. 29, 2019, by Sissons et al. (Copy not provided). (Copy not submitted herewith pursuant to the waiver of 37 C.F. R. § 1.98(a)(2)(iii) issued by the Office on Sep. 21, 2004).

Nilges et al., "Human papillomavirus type 16 E7 peptide-directed CD8+ T cells from patients with cervical cancer are cross-reactive with the coronavirus NS2 protein," J Virol. (2003) May;77(9):5464-74.

STONE etl al., "Opposite effects of Endogenous Peptide—MHC Class 1 on T Cell Activity in the Presence and Absence of CD8." J Immunol. May 1, 2011;186(9)5193-200.

Tang et al., "The advantages of PD1 activating chimeric receptor (PD1-ACR) engineered lymphocytes for PDL1+ cancer therapy," Am J Transl Res., (2015) 7(3):460-473.

Garcillan. "List of Jurkat derived cells lines deficient in some TCR subunits" (2015) Retrieved from https://www.researchgate.net/post/Are_there_any_human_T_cell_lines_defective_for_both_the_alpha_and_beta_TCR_subunits/54c2262fd5a3f2fd0e8b4635/citation/download. Retrieved on Jun. 23, 2020.

Hinrichs et al., "A phase I/II clinical trial of E6 T-cell receptor gene therapy for human papillomavirus (HPV)-associated epithelial cancers." J Clin Oncol 35, 2017 (suppl; abstr 3009).

Hoogenboom et al. in Methods in Molecular Biology 178:1-37 (O'Brien et al., ed., Humana Press, Totowa, NJ, (2001).

Huang et al., "DNA Transposons for Modification of Human Primary T Lymphocytes," In: Baum C. (eds) Genetic Modification of Hematopoietic Stem Cells. Methods In Molecular Biology™, vol. 506. Humana Press. (2009) 115-126.

Janeway et al., Immunobiology: The Immune System in Health and Disease, 3rd Ed., Current Biology Publications, p. 4:33, 1997.

Kindt et al. Kuby Immunology, 6th ed., W.H. Freeman and Co., p. 91 (2007).

Methods in Molecular Medicine, vol. 58: Metastasis Research Protocols, vol. 2: Cell Behavior In Vitro and In Vivo, p. 17-23 Edited by: S. A. Brooks and U. Schumacher © Humana Press Inc., Totowa, NJ.

Tsang et al., "Identification and Characterization of Enhancer Agonist Human Cytotoxic T-cell Epitopes of the Human Papillomavirus Type 16 (HPV16) E6/E7" Vaccine (2017) 35(19): 2605-2611.

U.S. Appl. No. 16/338,452, filed Mar. 29, 2019, by Sissons et al.

Alonso-Camino et al., "CARbodies: Human Antibodies Against Cell Surface Tumor Antigens Selected From Repertoires Displayed on T Cell Chimeric Antigen Receptors," Mol Ther Nucl Acids (2013) 2(5): e93. (11 pgs).

Banu et al., "Building and Optimizing a Virus-specific T Cell Receptor Library for Targeted Immunotherapy in Viral Infections." Sci Rep. Feb. 25, 2014;4:4166. (10 pgs).

Binkowski et al., "Predicting HLA Class I Non-Permissive Amino Acid Residues Substitutions." PLoS One 2012. 7(8): e41710. (12 pgs).

Boris-Lawrie et al., "Recent advances in retrovirus vector technology," Cur. Opin. Genet. Develop. (1993) 3:102-109.

Brash et al., "Strontium phosphate transfection of human cells in primary culture: stable expression of the simian virus 40 large-T-antigen gene in primary human bronchial epithelial cells," Mol. Cell Biol., (1987) 7: 2031-2034.

Burns et al., "Vesicular stomatitis virus G glycoprotein pseudotyped retroviral vectors concentration to very high titer and efficient gene transfer into mammalian and nonmammalian cells," Proc. Natl. Acad. Sci. USA, (1993) 90:8033-8037.

Cameron et al., "Identification of a Titin-derived HLA-A1-presented peptide as a cross-reactive target for engineered MAGE A3-directed T cells." Sci Transl Med. Aug. 7, 2013;5(197):197ra103. (24 pgs).

Campillo-Davo et al., "Efficient and Non-genotoxic RNA-Based Engineering of Human T Cells Using Tumor-Specific T Cell Receptors With Minimal TCR Mispairing." Front Immunol. Nov. 7, 2018;9:2503. (14 pgs).

Carlens et al., "Ex vivo T lymphocyte expansion for retroviral transduction: influence of serum-free media on variations in cell expansion rates and lymphocyte subset distribution," Exp Hematol., (2000) 28(10): 1137-46.

Cavalieri et al., "Human T lymphocytes transduced by lentiviral vectors in the absence of TCR activation maintain an intact immune competence," Blood, (2003) 102(2):497-505.

Cheever et al., "The prioritization of cancer antigens: a national cancer institute pilot project for the acceleration of translational research." Clin Cancer Res. Sep. 1, 2009;15(17):5323-37.

Chervin et al., "Engineering higher affinity T cell receptors using a T cell display system," J Immunol Methods, (2008) 339(2): 175-84.

Chicaybam et al., "An Efficient Low Cost Method for Gene Transfer to T Lymphocytes," PLoS One, (2013) 8(3): e60298. (11 pgs).

Cho et al., "Human mammalian cell sorting using a highly integrated micro-fabricated fluorescence-activated cell sorter (µFACS)," Lab Chip, (2010) 10(12):1567-1573.

Chothia et al., "The outline structure of the T-cell alpha beta receptor," EMBO J., (1988) 7(12):3745-3755.

Chowdhury, "Engineering hot spots for affinity enhancement of antibodies," Methods Mol. Biol. 207:179-196 (2008).

Clackson et al., "Making antibody fragments using phage display libraries," Nature, (1991) 352(6336):624-628.

Clinical Trial Study Record No. NCT01462838. Updated Jun. 23, 2015. Accessed Jun. 20, 2019. (6 pgs).

Clinical Trial Study Record No. NCT02280811. Updated Sep. 6, 2017. Accessed Mar. 28, 2019. (10 pgs).

Clinical Trial Study Record No. NCT02291055. Updated in Mar. 14, 2018. Accessed Jun. 20, 2019. (6 pgs).

(56) References Cited

OTHER PUBLICATIONS

Clinical Trial Study Record No. NCT02379520. Updated Dec. 13, 2019. Accessed Mar. 28, 2019. (8 pgs).

Clinical Trial Study Record No. NCT02426892. Updated in May 10, 2019. Accessed Jun. 20, 2019. (8 pgs).

Clinical Trial Study Record No. NCT02526316. Updated in Jul. 2, 2017. Accessed Jun. 20, 2019. (8 pgs).

Clinical Trial Study Record No. NCT02858310. Updated Mar. 18, 2019. Accessed Mar. 28, 2019. (10 pgs).

Clinical Trial Study Record No. NCT03260023. Updated in Mar. 21, 2019. Accessed Jun. 20, 2019. (8 pgs).

Clinical Trial Study Record No. NCT03439085. Updated in May 29, 2019. Accessed Jun. 20, 2019. (12 pgs).

Cooper et al., "T-cell clones can be rendered specific for CD19: toward the selective augmentation of the graft-versus-B-lineage leukemia effect," Blood, (2003) 101:1637-1644.

Croft et al., "Targeted Insertion of an HPV-16 E7-Specific Engineered T Cell Receptor into the TRAC Locus." Cancer Immunol. Res.Feb. 1, 2019;7(2 Suppl.):Abstract nr A027. (4pgs).

Croft et al., "Targeted Insertion of an HPV-16 E7-Specific Engineered T Cell Receptor into the TRAC Locus." Poster Abstract nr A027, presented at AACR 2018 on Apr. 14, 2018.

Daniel-Meshulam et al., "How (specific) would like your T-cells today? Generating T-cell therapeutic function through TCR-gene transfer." Front Immunol. Jul. 6, 2012;3:186.(13 pgs).

Davila et al., "CD19 CAR-Targeted T Cells Induce Long-Term Remission and B Cell Aplasia in an Immunocompetent Mouse Model of B Cell Acute Lymphoblastic Leukemia," PLoS One, (2013) 8(4): e61338. (14 pgs).

De Castro et al., "ScanProsite: detection of PROSITE signature matches and ProRule-associated functional and structural residues in proteins.," Nucleic Acids Res. (2006); 34(Web Server issue):W362-5.

De Felipe et al., "Targeting of proteins derived from self-processing polyproteins containing multiple signal sequences," Traffic, (2004) 5(8):616-626.

De Felipe, "Skipping the co-expression problem: the new 2A "CHYSEL" technology," Genetic Vaccines and Ther., (2004) 2:13. (6 pgs).

Draper et al., "Targeting of HPV-16+ Epithelial Cancer Cells by TCR Gene Engineered T Cells Directed against E6," Clinical Cancer Research, (2015) 21(19):4431-4439.

Ehrenmann et al., "IMGT/3Dstructure-DB and IMGT/DomainGapAlign: a database and a tool for immunoglobulins or antibodies, T cell receptors, MHC, IgSF and MhcSF." Nucleic Acids Res. Jan. 2010;38(Database issue):D301-7.

Endo et al., "High-throughput, genome-scale protein production method based on the wheat germ cell-free expression system," Biotechnol. Adv., (2003) 21:695-713.

Fedorov et al., "PD-1- and CTLA-4-based inhibitory chimeric antigen receptors (iCARs) divert off-target immunotherapy responses," Sci. Transl. Medicine, (2013) 5(215):215RA172. (25 pgs).

Flatman et al., "Process analytics for purification of monoclonal antibodies," J. Chromatogr. B, (2007) 848(1):79-87.

Gerngross, "Advances in the production of human therapeutic proteins in yeasts and filamentous fungi," Nat. Biotech., (2004) 22(11):1409-1414.

Haga-Friedman et al., "Incorporation of transmembrane hydrophobic mutations in the TCR enhance its surface expression and T cell functional avidity," Journal of Immunology, (2012) 188:5538-5546.

Hermans et al., "The VITAL assay: a versatile fluorometric technique for assessing CTL- and NKT-mediated cytotoxicity against multiple targets in vitro and in vivo," J. Immunological Methods, 285(1): 25-40 (2004).

Ho et al., "Cytolytic CD8+ T cells directed against a cryptic epitope derived from a retroviral alternative reading frame confer disease protection." J Immunol. Feb. 15, 2006;176(4):2470-5.

Ho et al., "In vitro methods for generating CD8+ T-cell clones for immunotherapy from the naïve repertoire," J. Immunol. Methods, (2006) 310(1-2):40-52.

Holler et al., "In vitro evolution of a T cell receptor with high affinity for peptide/MHC," Proc Natl Acad Sci USA, (2000) 97(10):5387-92.

Holler et al., "TCRs with high affinity for foreign pMHC show self-reactivity," Nat Immunol, (2003) 4(1):55-62.

Hudecek et al., "Receptor Affinity and Extracellular Domain Modifications Affect Tumor Recognition by ROR1-Specific Chimeric Antigen Receptor T Cells," Clin. Cancer Res., (2013) 19(12):3153-3164.

Johnston, "Biolistic transformation: microbes to mice," Nature, (1990) 346: 776-777.

Jones et al., "Distinct CDR3 conformations in TCRs determine the level of cross-reactivity for diverse antigens, but not the docking orientation." J Immunol. Nov. 1, 2008;181(9):6255-64.

Jores et al., "Resolution of hypervariable regions in T-cell receptor beta chains by a modified Wu-Kabat index of amino acid diversity," Proc. Nat'l Acad. Sci. USA, (1990) 87(23):9138-42.

Joyce et al., "T Cell Exclusion, Immune Privilege, and the Tumor Microenvironment." Science Apr. 3, 2015;342(6230);74-80.

Kanda et al., "Comparison of cell lines for stable production of fucose-negative antibodies with enhanced ADCC," Biotechnol. Bioeng., (2006) 94(4):680-688.

Kerry et al., "Interplay between TCR Affinity and Necessity of Coreceptor Ligation High-Affinity Peptide-MHC/TCR Interaction Overcomes Lack of CD8 Engagement," J. Immunology, (2003) 171(9): 4493-4503.

Kerry et al., "Memory CD8+ T cells require CD8 coreceptor engagement for calcium mobilization and proliferation, but not cytokine production," Immunology (2005) 114(1):44-52.

Kessels et al., "Generation of T cell help through a MHC class I-restricted TCR." J Immunol. Jul. 15, 2006;177(2):976-82.

Klebanoff et al., "Sorting through subsets: Which T cell populations mediate highly effective adoptive immunotherapy?" J Immunother., (2012) 35(9):651-660.

Kochenderfer et al., "Construction and preclinical evaluation of an anti-CD19 chimeric antigen receptor," J. Immunotherapy, (2009) 32(7):689-702.

Koste et al., "T-cell receptor transfer into human T cells with ecotropic retroviral vectors," Gene Therapy, (2014) 21(5):533-8.

Kotb, "Bacterial pyrogenic exotoxins as superantigens," Clinical Microbiology Reviews, (1995) 8:411-426.

Kuball et al., "Facilitating matched pairing and expression of TCR chains introduced into human T cells," Blood, (2007) 109:2331-2338.

Lefranc et al., "IMGT unique numbering for immunoglobulin and T cell receptor variable domains and Ig superfamily V-like domains," Developmental and Comparative Immunology, (2003) 27(1):55-77.

Li et al., "Directed evolution of human T-cell receptors with picomolar affinities by phage display," Nat Biotechnol, (2005) 23(3):349-54.

Li et al., "Optimization of humanized IgGs in glycoengineered Pichia pastoris," Nat. Biotech., (2006) 24(2):210-215.

Lloyd et al., "Beyond the Antigen Receptor: Editing the Genome of T-Cells for Cancer Adoptive Cellular Therapies," Frontiers in Immunology, (2013) 4(221):1-7.

Lupton et al., "Dominant positive and negative selection using a hygromycin phosphotransferase-thymidine kinase fusion gene," Mol. and Cell Biol., (1991) 11(6):3374-8.

Lyford-Pike et al., "Evidence for a Role of the PD-1:PD-L1 Pathway in Immune Resistance of HPV-Associated Head and Neck Squamous Cell Carcinoma." Cancer Res. Mar. 15, 2013;73(6):1733-41.

Manuri et al., "piggyBac Transposon/Transposase System to Generate CD19-Specific T Cells for the Treatment of B-Lineage Malignancies," Hum Gene Ther, (2010) 21(4): 427-437.

Miller and Rosman, "Improved retroviral vectors for gene transfer and expression," BioTechniques, (1989) 7(9):980-990.

Miller, "Retrovirus packaging cells," Human Gene Therapy, (1990) 1(1):5-14.

Moran et al., "T cell receptor signal strength in Treg and iNKT cell development demonstrated by a novel fluorescent reporter mouse." J Exp Med. Jun. 6, 2011;208(6):1279-89.

(56) References Cited

OTHER PUBLICATIONS

Mullen et al., "Transfer of the bacterial gene for cytosine deaminase to mammalian cells confers lethal sensitivity to 5-fluorocytosine: A negative selection system," Proc. Natl. Acad. Sci. USA, (1992) 89:33-37.
Nagarsheth et al., "Regression of epithelial cancers in humans following t-cell receptor gene therapy targeting human papillomavirus-16 E7." J. Clin. Oncology May 20, 2018; 36(15 suppl):3043-3043.
Nilges et al., "Human papillomavirus type 16 E7 peptide-directed CD8+ T cells from patients with cervical cancer are cross-reactive with the coronavirus NS2 protein," J Virol. May 2003; 77(9):5464-74.
Norberg et al., "Regression of Epithelial Cancers Following T Cell Receptor Gene Therapy Targeting Human Papillomavirus-16 E7." Blood 2018 132:492. (5 pgs).
Okazaki et al., "Fucose depletion from human IgG1 oligosaccharide enhances binding enthalpy and association rate between IgG1 and FcgammaRIIIa," J. Mol. Biol., (2004) 336(5):1239-1249.
Osborn et al., "Evaluation of TCR Gene Editing Achieved by TALENs, CRISPR/Cas9, and megaTAL Nucleases," Mol. Ther., (2016) 24(3):570-581.
Park et al., "Treating cancer with genetically engineered T cells," Trends Biotechnol., (2011) 29(11):550-557.
Portolano et al., "Lack of promiscuity in autoantigen-specific H and L chain combinations as revealed by human H and L chain "roulette".," J. Immunol., (1993), 150:880-887.
Protocol Details "A Phase I/II Trial of T Cell Receptor Gene Therapy Targeting HPV-16 E7 with or without PD-1 Blockade for HPV-Associated Cancers." Record No. 16-C-0154; retrieved from https://clinicalstudies.info.nih.gov/ProtocolDetails.aspx?A_2016-C-0154.html; retrieved on Mar. 28, 2019. (5 pgs).
Riddell et al., "Phase I study of cellular adoptive immunotherapy using genetically modified CD8+ HIV-specific T cells for HIV seropositive patients undergoing allogeneic bone marrow transplant," Human Gene Therapy, (1992) 3:319-338.
Riemer et al., "A conserved E7-derived cytotoxic T lymphocyte epitope expressed on human papillomavirus 16-transformed HLA-A2+ epithelial cancers," J Biol Chem (2010) 285(38):29608-29622.
Ripka et al., "Two Chinese hamster ovary glycosylation mutants affected in the conversion of GDP-mannose to GDP-fucose," Arch. Biochem. Biophys., (1986) 249(2):533-545.
Robbins et al., "Single and dual amino acid substitutions in TCR CDRs can enhance antigen-specific T cell functions," J Immunology, (2008) 180(9): 6116-6131.
Rosenberg, "Cell transfer immunotherapy for metastatic solid cancer—what clinicians need to know," Nat Rev Clin Oncol., (2011) 8(10):577-85.
Sadelain et al., "The basic principles of chimeric antigen receptor design," Cancer Discov. (2013) 3(4): 388-398.
Scarpa et al., "Characterization of recombinant helper retroviruses from Moloney-based vectors in ecotropic and amphotropic packaging cell lines," Virology, (1991) 180(2):849-852.
Scatchard et al., "The Attractions of Proteins for Small Molecules and Ions," Ann. N.Y. Acad. Sci., (1949) 51(4):660-672.
Schlueter et al., "Specificity and binding properties of a single-chain T cell receptor," J. Mol. Biol., (1996) 256(5):859-69.
Sharma et al., "Efficient Sleeping Beauty DNA Transposition From DNA Minicircles," Molec Ther Nucl Acids, (2013) 2(2):e74. (10 pgs).
Sitaraman et al., "High-throughput protein expression using cell-free system," Methods Mol. Biol., (2009) 498: 229-44.
Spirin, "High-throughput cell-free systems for synthesis of functionally active proteins," Trends Biotechnol., (2004) 22(10):538-45.

Stone et al., "Role of T cell receptor affinity in the efficacy and specificity of adoptive T cell therapies." Front Immunol. Aug. 21, 2013;4:244. (16 pgs).
Stone et al., "T cell receptor binding affinities and kinetics: impact on T cell activity and specificity," Immunology. Feb. 2009;126(2):165-76.
Stone etl al., "Opposite effects of Endogenous Peptide-MHC Class I on T Cell Activity in the Presence and Absence of CD8." J Immunol. May 1, 2011;186(9)5193-200.
Szoka et al., "Comparative properties and methods of preparation of lipid vesicles (liposomes)," Ann. Rev. Biophys. Bioeng., (1980) 9:467-508.
Tang et al., "The advantages of PD1 activating chimeric receptor (PD1-ACR) engineered Tymphocytes for PDL1+ cancer therapy," Am J Transl Res., (2015) 7(3):460-473.
Terakura et al., "Generation of CD19-chimeric antigen receptor modified CD8+T cells derived from virus-specific central memory T cells," Blood, (2012) 119:72-82.
Themeli et al., "Generation of tumor-targeted human T lymphocytes from induced pluripotent stem cells for cancer therapy," Nat Biotechnol., (2013) 31(10): 928-933.
Thomas et al., "Molecular immunology lessons from therapeutic T-cell receptor gene transfer." Immunology. Feb. 2010;129(2):170-7.
Tsukahara et al., "CD19 target-engineered T-cells accumulate at tumor lesions in human B-cell lymphoma xenograft mouse models," Biochem Biophys Res Commun, (2013) 438(1): 84-9.
Turtle et al., "Engineered T cells for anti-cancer therapy," Curr. Opin. Immunol., (2012) 24(5): 633-39.
Van Loenen et al., "Mixed T cell receptor dimers harbor potentially harmful neoreactivity." Proc Natl Acad Sci USA. Jun. 15, 2010;107(24):10972-7.
Van Tedeloo et al., "High-level transgene expression in primary human T lymphocytes and adult bone marrow CD34+ cells via electroporation-mediated gene delivery," Gene Therapy, (2000) 7(16):1431-1437.
Verhoeyen et al., "Lentiviral vector gene transfer into human T cells," Methods Mol Biol., (2009) 506:97-114.
Wadhwa et al., "Receptor mediated glycotargeting," J. Drug Targeting, (1995) 3(2):111-27.
Wang et al., "Phenotypic and Functional Attributes of Lentivirus Modified CD19-specific Human CD8+ Central Memory T Cells Manufactured at Clinical Scale," J Immunother., (2012)35(9):689-701.
Weiss & Stobo, "Requirement for the coexpression of T3 and the T cell antigen receptor on a malignant human T cell line," J. Ex. Med., (1984) 160(5):1284-1299.
Wigler et al., "Transfer of purified herpes virus thymidine kinase gene to cultured mouse cells," Cell (1977) 11(1):223-32.
Wilson, "Tech.Sight. Analyzing biomolecular interactions," Science, (2002) 295(5562):2103-5.
Wolff et al., "Monoclonal antibody homodimers: enhanced antitumor activity in nude mice," Cancer Res., (1993) 53(11):2560-5.
Wu et al., "Adoptive T-cell therapy using autologous tumor-infiltrating lymphocytes for metastatic melanoma: current status and future outlook," Cancer, (2012) 18(2):160-75.
Yamane-Ohnuki et al., "Establishment of FUT8 knockout Chinese hamster ovary cells: An ideal host cell line for producing completely defucosylated antibodies with enhanced antibody-dependent cellular cytotoxicity," Biotech. Bioeng., (2004) 87(5):614-622.
Youde et al., "Use of Fluorogenic Histocompatibility Leukocyte Antigen-A*0201/HPV 16 E7 Peptide Complexes to Isolate Rare Human Cytotoxic T-Lymphocyte- recognizing Endogenous Human Papillomavirus Antigens." Cancer Research Jan. 15, 2000;60:365-371.

* cited by examiner

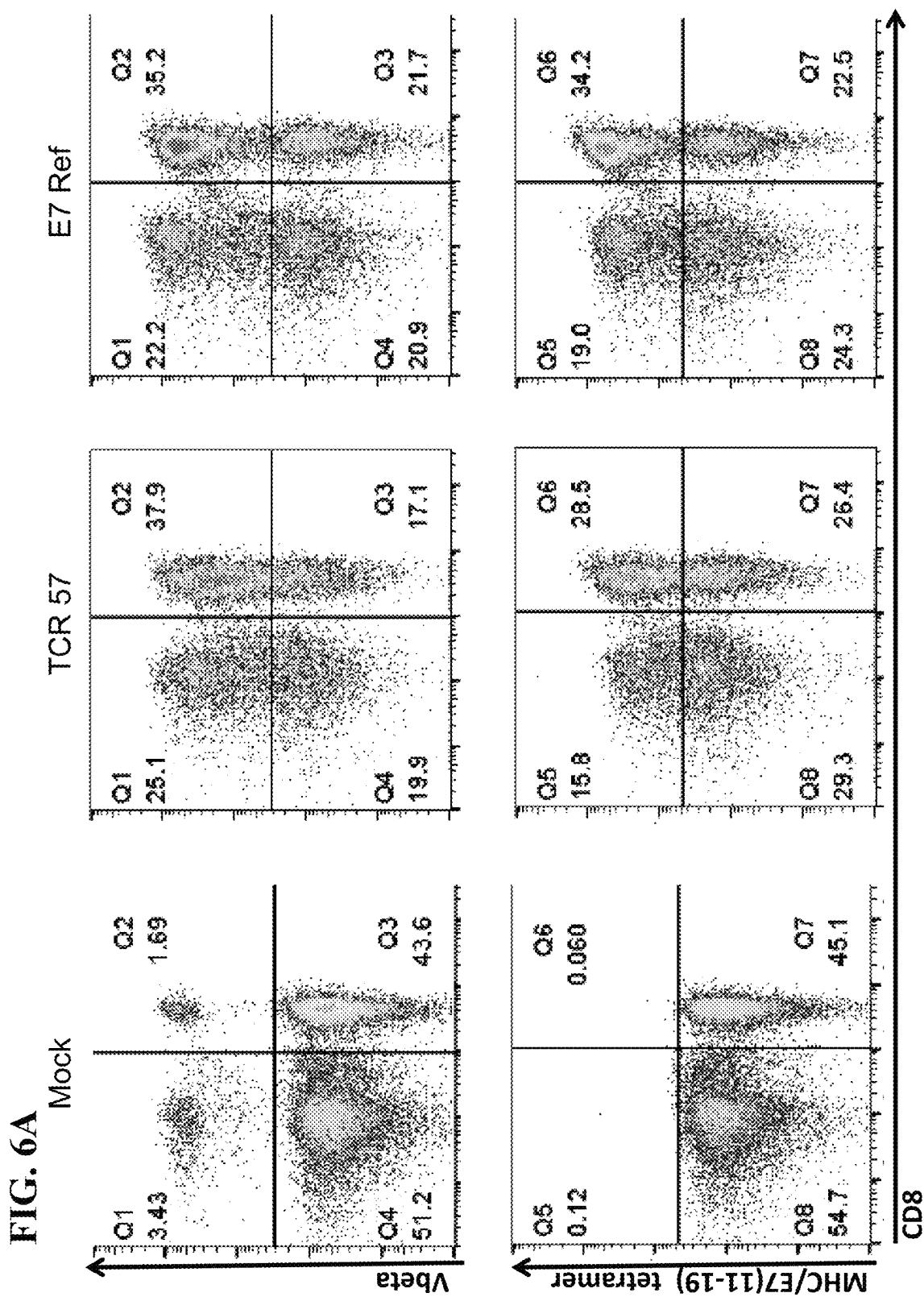

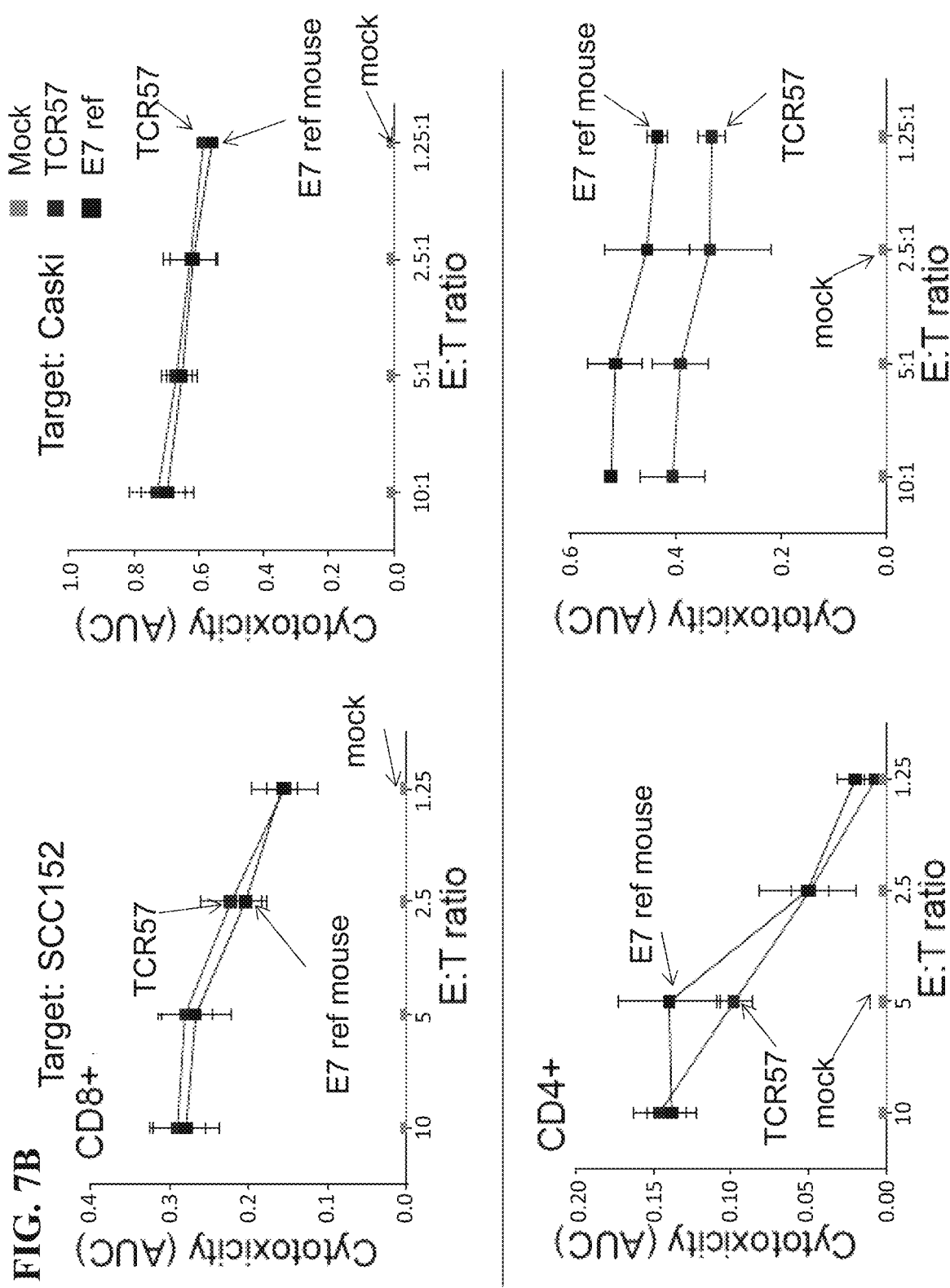

ABOVE: US 11,471,489 B2

T CELL RECEPTORS AND ENGINEERED CELLS EXPRESSING SAME

CROSS-REFERENCE TO RELATED APPLICATIONS

This application claims priority from U.S. provisional application No. 62/653,516, filed Apr. 5, 2018, entitled "T CELL RECEPTORS AND ENGINEERED CELLS EXPRESSING SAME," and U.S. provisional application No. 62/739,145, filed Sep. 28, 2018, entitled "T CELL RECEPTORS AND ENGINEERED CELLS EXPRESSING SAME," the contents of which are incorporated by reference in their entirety.

INCORPORATION BY REFERENCE OF SEQUENCE LISTING

The present application is being filed along with a Sequence Listing in electronic format. The Sequence Listing is provided as a file entitled 735042015100SeqList.txt, created Apr. 3, 2019, which is 664 kilobytes in size. The information in the electronic format of the Sequence Listing is incorporated by reference in its entirety.

FIELD

The present disclosure relates in some aspects to binding molecules, such as those that recognize or bind a peptide epitope of a cancer antigen, such as expressed on a cancer cell, including cells infected with human papilloma virus (HPV) or that contain HPV DNA sequences and/or those that recognize or bind a peptide epitope of HPV 16 E6 or E7, in the context of a major histocompatibility complex (MHC) molecule. In particular, the present disclosure relates to T cell receptors (TCRs) or antibodies, including antigen-binding fragments thereof, that bind or recognize such peptide epitopes. The present disclosure further relates to engineered cells comprising such binding molecules, e.g., TCRs or antibodies (and chimeric antigen receptors containing the antibodies), and uses thereof in adoptive cell therapy.

BACKGROUND

Human papillomavirus (HPV) is a common virus among human subjects that, in some cases, can be transmitted by skin-to-skin contact and is a common sexually transmitted virus. Certain subtypes of HPV, such as HPV 16, can lead to certain cancers, such as cervical and other cancers. In some cases, cancer can be associated with expression of the HPV oncoproteins E6 and/or E7. For example, HPV E6 and/or E7 may contribute to cancer progression by targeting tumor suppressor signaling pathways that are involved in cellular growth control. Certain therapeutic agents targeting HPV 16-expressing cells or cancers are available, but improved agents against HPV 16 are needed. Provided are embodiments that meet such needs.

SUMMARY

Provided herein are binding molecules, such as T cell receptors (TCRs), such as recombinant TCRs, that bind a peptide epitope of HPV 16 E6 or E7 and/or on cells infected with human papilloma virus (HPV) or that contain HPV DNA sequences, in the context of a major histocompatibility complex (MHC) molecule, engineered cells, such as engineered immune cells, e.g. engineered CD4+ and/or CD4+ T cells, expressing such molecules, and related methods or uses.

Provided herein are T cell receptors (TCRs) or antigen-binding fragment thereof, comprising an alpha chain comprising a variable alpha (Vα) region and a beta chain comprising a variable beta (Vβ) region, wherein: the Vα region comprises a complementarity determining region 1 (CDR-1), a complementarity determining region 2 (CDR-2), and a complementarity determining region 3 (CDR-3), comprising the amino acid sequences of SEQ ID NOs: 48, 49, and 50, respectively, and the Vβ region comprises a CDR-1, a CDR-2, and a CDR-3, comprising the amino acid sequences of SEQ ID NOs: 61, 62, and 63, respectively; the Vα region comprises a CDR-1, a CDR-2, and a CDR-3, comprising the amino acid sequences of SEQ ID NOs: 78, 79, and 80, respectively, and the Vβ region comprises a CDR-1, a CDR-2, and a CDR-3, comprising the amino acid sequences of SEQ ID NOs: 89, 90, and 91, respectively; the Vα region comprises a CDR-1, a CDR-2, and a CDR-3, comprising the amino acid sequences of SEQ ID NOs: 104, 105, and 106, respectively, and the Vβ region comprises a CDR-1, a CDR-2, and a CDR-3, comprising the amino acid sequences of SEQ ID NOs: 89, 90, and 115, respectively; the Vα region comprises a CDR-1, a CDR-2, and a CDR-3, comprising the amino acid sequences of SEQ ID NOs: 127, 128, and 129, respectively, and the Vβ region comprises a CDR-1, a CDR-2, and a CDR-3, comprising the amino acid sequences of SEQ ID NOs: 89, 90, and 138, respectively; the Vα region comprises a CDR-1, a CDR-2, and a CDR-3, comprising the amino acid sequences of SEQ ID NOs: 127, 128, and 150, respectively, and the Vβ region comprises a CDR-1, a CDR-2, and a CDR-3, comprising the amino acid sequences of SEQ ID NOs: 89, 90, and 158, respectively; the Vα region comprises a CDR-1, a CDR-2, and a CDR-3, comprising the amino acid sequences of SEQ ID NOs: 170, 171, and 172, respectively, and the Vβ region comprises a CDR-1, a CDR-2, and a CDR-3, comprising the amino acid sequences of SEQ ID NOs: 181, 182, and 183 respectively; the Vα region comprises a CDR-1, a CDR-2, and a CDR-3, comprising the amino acid sequences of SEQ ID NOs: 196, 197, and 198, respectively, and the Vβ region comprises a CDR-1, a CDR-2, and a CDR-3, comprising the amino acid sequences of SEQ ID NOs: 207, 208, and 209, respectively; or the Vα region comprises a CDR-1, a CDR-2, and a CDR-3, comprising the amino acid sequences of SEQ ID NOs: 222, 223, and 224, respectively, and the Vβ region comprises a CDR-1, a CDR-2, and a CDR-3, comprising the amino acid sequences of SEQ ID NOs: 233, 234, and 235, respectively. In particular embodiments of any of such provided TCRs, the TCR or antigen-binding fragment thereof binds to or recognizes a peptide epitope of human papillomavirus (HPV) 16 E7 in the context of an MHC molecule. In some embodiments, the peptide epitope is or comprises E7(11-19) YMLDLQPET (SEQ ID NO: 271).

Also provided herein are TCRs that contain a Vα region containing a CDR1, a CDR2 and a CDR3 as contained in a Vα region comprising the amino acid sequence set forth in any of SEQ ID NOs: 47, 77, 103, 126, 149, 169, 195, or 221; and a Vβ region containing a CDR1, a CDR2 and a CDR3 as contained in a Vβ region comprising the amino acid sequence set forth in any of SEQ ID NOs: 60, 88, 114, 137, 157, 180, 206, or 232. In particular embodiments of any of such provided TCRs, the TCR or antigen-binding fragment thereof binds to or recognizes a peptide epitope of human papillomavirus (HPV) 16 E7 in the context of an MHC molecule. In some embodiments, the peptide epitope is or comprises E7(11-19) YMLDLQPET (SEQ ID NO: 271).

In some of any such embodiments, the Vα region comprises the amino acid sequence set forth in any of SEQ ID NOs: 47, 77, 103, 126, 149, 169, 195, or 221 or an amino acid sequence that has at least 90%, 91%, 92%, 93%, 94%, 95%, 96%, 97%, 98%, or 99% sequence identity to any of SEQ ID Nos: 47, 77, 103, 126, 149, 169, 195, or 221; and the Vβ region comprises the amino acid sequence set forth in any of SEQ ID NOs: 60, 88, 114, 137, 157, 180, 206, or 232, or an amino acid sequence that has at least 90%, 91%, 92%, 93%, 94%, 95%, 96%, 97%, 98%, or 99% sequence identity to any of SEQ ID Nos: 60, 88, 114, 137, 157, 180, 206, or 232.

Provided herein is a T cell receptor (TCR) or antigen-binding fragment thereof, comprising an alpha chain comprising a variable alpha (Vα) region and a beta chain comprising a variable beta (Vβ) region, wherein: the Vα region comprises the amino acid sequence set forth in any of SEQ ID NOs: 47, 77, 103, 126, 149, 169, 195, or 221 or an amino acid sequence that has at least 90%, 91%, 92%, 93%, 94%, 95%, 96%, 97%, 98%, or 99% sequence identity thereto; and/or the Vβ region comprises the amino acid sequence set forth in any of SEQ ID NOs: 60, 88, 114, 137, 157, 180, 206, or 232, or an amino acid sequence that has at least 90%, 91%, 92%, 93%, 94%, 95%, 96%, 97%, 98%, or 99% sequence identity thereto. In particular embodiments of any of such provided TCRs, the TCR or antigen-binding fragment thereof binds to or recognizes a peptide epitope of human papillomavirus (HPV) 16 E7 in the context of an MHC molecule. In some embodiments, the peptide epitope is or comprises E7(11-19) YMLDLQPET (SEQ ID NO: 271).

Also provided herein is a T cell receptor (TCR) or antigen-binding fragment thereof, comprising an alpha chain comprising a variable alpha (Vα) region and a beta chain comprising a variable beta (Vβ) region, wherein: the Vα region comprises the amino acid sequence set forth in any of SEQ ID NOs: 47, 77, 103, 126, 149, 169, 195, or 221 or an amino acid sequence that has at least 90%, 91%, 92%, 93%, 94%, 95%, 96%, 97%, 98%, or 99% sequence identity thereto; and the Vβ region comprises the amino acid sequence set forth in any of SEQ ID NOs: 60, 88, 114, 137, 157, 180, 206, or 232, or an amino acid sequence that has at least 90%, 91%, 92%, 93%, 94%, 95%, 96%, 97%, 98%, or 99% sequence identity thereto. In particular embodiments of any of such provided TCRs, the TCR or antigen-binding fragment thereof binds to or recognizes a peptide epitope of human papillomavirus (HPV) 16 E7 in the context of an MHC molecule. In some embodiments, the peptide epitope is or comprises E7(11-19) YMLDLQPET (SEQ ID NO: 271).

Among any of such provided TCRs are those containing CDRs as described herein. In some embodiments, among such TCRs are those containing a Vα region containing a CDR1, a CDR2 and a CDR3 as contained in a Vα region comprises the amino acid sequence set forth in any of SEQ ID NOs: 47, 77, 103, 126, 149, 169, 195, or 221; and Vβ region contains a CDR1, a CDR2 and a CDR3 as contained in a Vβ region set forth in any of SEQ ID NOs: 60, 88, 114, 137, 157, 180, 206, or 232.

In particular embodiments of any of the TCRs provided herein, the Vα region comprises the amino acid sequence set forth in any of SEQ ID NOs: 47, 149, 169, 195, or 221 or an amino acid sequence that has at least 90%, 91%, 92%, 93%, 94%, 95%, 96%, 97%, 98%, or 99% sequence identity thereto. In other particular embodiments, the Vα region comprises the amino acid sequence set forth in any of SEQ ID NOs: 103, 126, or an amino acid sequence that has at least 91%, 92%, 93%, 94%, 95%, 96%, 97%, 98%, or 99% sequence identity thereto.

In certain embodiments of any of the TCRs provided herein, provided herein is a T cell receptor (TCR) or antigen-binding fragment thereof described herein, wherein: the Vβ region comprises the amino acid sequence set forth in any of SEQ ID NOs: 60, 180, or 232, or an amino acid sequence that has at least 90%, 91%, 92%, 93%, 94%, 95%, 96%, 97%, 98%, or 99% sequence identity thereto. In other certain embodiments, the Vβ region comprises the amino acid sequence set forth in SEQ ID NO: 206, or an amino acid sequence that has at least 90.5%, 91%, 92%, 93%, 94%, 95%, 96%, 97%, 98%, or 99% sequence identity thereto. In other certain embodiments, the Vβ region comprises the amino acid sequence set forth in SEQ ID NOs: 114 or 137, or an amino acid sequence that has at least 97.5%, 98%, or 99% sequence identity thereto. In other certain embodiments, the Vβ region comprises the amino acid sequence set forth in SEQ ID NO: 157, or an amino acid sequence that has at least 98.5%, or 99% sequence identity thereto. In other certain embodiments, the Vβ region comprises the amino acid sequence set forth in SEQ ID NO: 88, or an amino acid sequence that has at least 99.5% sequence identity thereto.

In particular embodiments of any of such provided TCRs, the TCR or antigen-binding fragment thereof binds to or recognizes a peptide epitope of human papillomavirus (HPV) 16 E7 in the context of an MHC molecule. In some embodiments, the peptide epitope is or comprises E7(11-19) YMLDLQPET (SEQ ID NO: 271).

In some embodiments, the TCR or antigen-binding fragment thereof, when expressed on the surface of a T cell, stimulates cytotoxic activity against a target cancer cell. In some embodiments, the target cancer cell contains HPV DNA sequences or expresses HPV 16. In some embodiments, the target cancer cell is SCC152. In certain embodiments, the target cancer cell expresses a peptide epitope of human papillomavirus (HPV) 16 E7 in the context of an MHC molecule. In some embodiments, the peptide epitope is or comprises E7(11-19) YMLDLQPET (SEQ ID NO: 271).

In particular embodiments of any of such provided TCRs, the Vα region comprises a complementarity determining region 1 (CDR-1), a CDR-2, and a CDR-3, respectively comprising the CDR-1, the CDR-2, and the CDR-3 amino acid sequences contained within a Vα region amino acid sequence set forth in any of SEQ ID NOs: 47, 77, 103, 126, 149, 169, 195, or 221; and/or the Vβ region comprises a complementarity determining region 1 (CDR-1), a CDR-2, and a CDR-3, respectively comprising the CDR-1, the CDR-2, and the CDR-3 amino acid sequences contained within a Vβ region amino acid sequence set forth in any of SEQ ID NOs: 60, 88, 114, 137, 157, 180, 206, or 232.

In some of any such embodiments: the Vα region comprises a complementarity determining region 3 (CDR-3) comprising the amino acid sequence set forth in any of SEQ ID NOs: 50, 80, 106, 129, 150, 172, 198, or 224; and/or the Vβ region comprises a complementarity determining region 3 (CDR-3) comprising an amino acid sequence set forth in any of SEQ ID NOs: 63, 91, 115, 138, 158, 183, 209, or 235. In certain embodiments of any of such provided TCRs, the Vα region comprises: a complementarity determining region 1 (CDR-1) comprising an amino acid sequence set forth in any of SEQ ID NOs: 48, 78, 104, 127, 170, 196, or 222; and/or a complementarity determining region 2 (CDR-2) comprising an amino acid sequence set forth in any of SEQ ID NOs: 49, 79, 105, 128, 171, 197, or 223. In particular embodiments, the Vβ region comprises: a complementarity determining region 1 (CDR-1) comprising the amino acid sequence set forth in any of SEQ ID NOs: 61, 89, 181, 207, or 233; and/or a complementarity determining region 2 (CDR-2) comprising the amino acid sequence set forth in SEQ ID NO: 62, 90, 182, 208, or 234.

In some of any such embodiments: the Vα region comprises a CDR-1, a CDR-2, and a CDR-3, comprising the amino acid sequences of SEQ ID NOs: 48, 49, and 50, respectively, and the Vβ region comprises a CDR-1, a CDR-2, and a CDR-3, comprising the amino acid sequences of SEQ ID NOs: 61, 62, and 63, respectively; the Vα region comprises a CDR-1, a CDR-2, and a CDR-3, comprising the amino acid sequences of SEQ ID NOs: 78, 79, and 80, respectively, and the Vβ region comprises a CDR-1, a CDR-2, and a CDR-3, comprising the amino acid sequences of SEQ ID NOs: 89, 90, and 91, respectively; the Vα region comprises a CDR-1, a CDR-2, and a CDR-3, comprising the amino acid sequences of SEQ ID NOs: 104, 105, and 106, respectively, and the Vβ region comprises a CDR-1, a CDR-2, and a CDR-3, comprising the amino acid sequences of SEQ ID NOs: 89, 90, and 115, respectively; the Vα region comprises a CDR-1, a CDR-2, and a CDR-3, comprising the amino acid sequences of SEQ ID NOs: 127, 128, and 129, respectively, and the Vβ region comprises a CDR-1, a CDR-2, and a CDR-3, comprising the amino acid sequences of SEQ ID NOs: 89, 90, and 138, respectively; the Vα region comprises a CDR-1, a CDR-2, and a CDR-3, comprising the amino acid sequences of SEQ ID NOs: 127, 128, and 150, respectively, and the Vβ region comprises a CDR-1, a CDR-2, and a CDR-3, comprising the amino acid sequences of SEQ ID NOs: 89, 90, and 158, respectively; the Vα region comprises a CDR-1, a CDR-2, and a CDR-3, comprising the amino acid sequences of SEQ ID NOs: 170, 171, and 172, respectively, and the Vβ region comprises a CDR-1, a CDR-2, and a CDR-3, comprising the amino acid sequences of SEQ ID NOs: 181, 182, and 183 respectively; the Vα region comprises a CDR-1, a CDR-2, and a CDR-3, comprising the amino acid sequences of SEQ ID NOs: 196, 197, and 198, respectively, and the Vβ region comprises a CDR-1, a CDR-2, and a CDR-3, comprising the amino acid sequences of SEQ ID NOs: 207, 208, and 209, respectively; or the Vα region comprises a CDR-1, a CDR-2, and a CDR-3, comprising the amino acid sequences of SEQ ID NOs: 222, 223, and 224, respectively, and the Vβ region comprises a CDR-1, a CDR-2, and a CDR-3, comprising the amino acid sequences of SEQ ID NOs: 233, 234, and 235, respectively.

In certain embodiments the Vα and Vβ regions comprise the amino acid sequences of SEQ ID NOs: 47 and 60, respectively, or an amino acid sequence that has at least 90%, 91%, 92%, 93%, 94%, 95%, 96%, 97%, 98%, or 99% sequence identity thereto. In certain embodiments, the Vα and Vβ regions comprise the amino acid sequences of SEQ ID NOs: 77 and 88, respectively, or an amino acid sequence that has at least 90%, 91%, 92%, 93%, 94%, 95%, 96%, 97%, 98%, or 99% sequence identity thereto. In certain embodiments, the Vα and Vβ regions comprise the amino acid sequences of SEQ ID NOs: 77 and 88, respectively, or an amino acid sequence that has at least 90%, 91%, 92%, 93%, 94%, 95%, 96%, 97%, 98%, or 99.5% sequence identity thereto. In certain embodiments, the Vα and Vβ regions comprise the amino acid sequences of SEQ ID NOs: 103 and 114, respectively, or an amino acid sequence that has at least 90%, 91%, 92%, 93%, 94%, 95%, 96%, 97.5%, 98%, or 99% sequence identity thereto. In certain embodiments, the Vα and Vβ regions comprise the amino acid sequences of SEQ ID NOs: 126 and 137, respectively, or an amino acid sequence that has at least 90%, 91%, 92%, 93%, 94%, 95%, 96%, 97.5%, 98%, or 99% sequence identity thereto. In certain embodiments, the Vα and Vβ regions comprise the amino acid sequences of SEQ ID NOs: 149 and 157, respectively, or an amino acid sequence that has at least 90%, 91%, 92%, 93%, 94%, 95%, 96%, 97%, 98.5%, or 99% sequence identity thereto. In certain embodiments, the Vα and Vβ regions comprise the amino acid sequences of SEQ ID NOs: 169 and 180, respectively, or an amino acid sequence that has at least 90%, 91%, 92%, 93%, 94%, 95%, 96%, 97%, 98%, or 99% sequence identity thereto. In certain embodiments, the Vα and Vβ regions comprise the amino acid sequences of SEQ ID NOs: 195 and 206, respectively, or an amino acid sequence that has at least 90.5%, 91%, 92%, 93%, 94%, 95%, 96%, 97%, 98%, or 99% sequence identity thereto. In certain embodiments, the Vα and Vβ regions comprise the amino acid sequences of SEQ ID NOs: 221 and 232, respectively, or an amino acid sequence that has at least 90%, 91%, 92%, 93%, 94%, 95%, 96%, 97%, 98%, or 99% sequence identity thereto.

In particular embodiments: the Vα and Vβ regions comprise the amino acid sequences of SEQ ID NOs: 47 and 60, respectively. In particular embodiments, the Vα and Vβ regions comprise the amino acid sequences of SEQ ID NOs: 77 and 88, respectively. In particular embodiments, the Vα and Vβ regions comprise the amino acid sequences of SEQ ID NOs: 77 and 88, respectively. In particular embodiments, the Vα and Vβ regions comprise the amino acid sequences of SEQ ID NOs: 103 and 114, respectively. In particular embodiments, the Vα and Vβ regions comprise the amino acid sequences of SEQ ID NOs: 126 and 137, respectively. In particular embodiments, the Vα and Vβ regions comprise the amino acid sequences of SEQ ID NOs: 149 and 157, respectively. In particular embodiments, the Vα and Vβ regions comprise the amino acid sequences of SEQ ID NOs: 169 and 180, respectively. In particular embodiments, the Vα and Vβ regions comprise the amino acid sequences of SEQ ID NOs: 195 and 206, respectively. In particular embodiments, the Vα and Vβ regions comprise the amino acid sequences of SEQ ID NOs: 221 and 232, respectively.

In some of any embodiments, the Vα region comprises a complementarity determining region 1 (CDR-1), a CDR-2, and a CDR-3, respectively comprising the CDR-1, the CDR-2, and the CDR-3 amino acid sequences contained within a Vα region amino acid sequence set forth in SEQ ID NO: 47; and the Vβ region comprises a complementarity determining region 1 (CDR-1), a CDR-2, and a CDR-3, respectively comprising the CDR-1, the CDR-2, and the CDR-3 amino acid sequences contained within a Vβ region amino acid sequence set forth in SEQ ID NO: 60.

In some of any such embodiments: the Vα region comprises a CDR-1, a CDR-2, and a CDR-3, comprising the amino acid sequences of SEQ ID NOs: 48, 49, and 50, respectively, and the Vβ region comprises a CDR-1, a CDR-2, and a CDR-3, comprising the amino acid sequences of SEQ ID NOs: 61, 62, and 63. In some of any such embodiments, the Vα and Vβ regions comprise the amino acid sequences of SEQ ID NOs: 47 and 60, respectively.

In certain embodiments: the Vα region comprises a CDR-1, a CDR-2, and a CDR-3, comprising the amino acid sequences of SEQ ID NOs: 196, 197, and 198, respectively, and the Vβ region comprises a CDR-1, a CDR-2, and a CDR-3, comprising the amino acid sequences of SEQ ID NOs: 207, 208, and 209, respectively. In some of any such embodiments, the Vα and Vβ regions comprise the amino acid sequences of SEQ ID NOs: 195 and 206, respectively.

In certain embodiments, the Vα region comprises a CDR-1, a CDR-2, and a CDR-3, comprising the amino acid sequences of SEQ ID NOs: 222, 223, and 224, respectively, and the Vβ region comprises a CDR-1, a CDR-2, and a CDR-3, comprising the amino acid sequences of SEQ ID NOs: 233, 234, and 235, respectively. In some of any such embodiments, the Vα and Vβ regions comprise the amino acid sequences of SEQ ID NOs: 221 and 232, respectively.

In some of any such embodiments, the alpha chain further comprises an alpha constant (Cα) region and/or the beta chain further comprises a beta constant (Cβ) region. In certain embodiments, the Cα and Cβ regions are mouse constant regions. In particular embodiments, the Cα and Cβ regions are human constant regions. In particular embodiments, the Cα and/or Cβ regions comprise introduction of one or more cysteine residues that are capable of forming one or more non-native disulfide bridges between the alpha chain and beta chain.

In some of any such embodiments, the Cα region includes the amino acid sequence set forth in SEQ ID NO: 15, 275, 276, 277, 278, 279, 280, 281 or 282, or a sequence of amino acids that has at least 90% sequence identity to a sequence set forth in SEQ ID NO: 15, 275, 276, 277, 278, 279, 280, 281 or 282; and/or the Cβ region includes the amino acid sequence set forth in SEQ ID NO: 30, 283, 284 or 285 or a sequence of amino acids that has at least 90% sequence identity to the amino acid sequence set forth in SEQ ID NO: 30, 283, 284 or 285. In certain embodiments, the Cα region comprises the amino acid sequence set forth in SEQ ID NO: 15, or a sequence of amino acids that has at least 90% sequence identity thereto; and/or the Cβ region comprises the amino acid sequence set forth in SEQ ID NO: 30, or a sequence of amino acids that has at least 90% sequence identity thereto.

In particular embodiments: the alpha chain comprises the amino acid sequence set forth in SEQ ID NOs: 44, 74, 100, 123, 146, 166, 192, or 218, or a sequence of amino acids that has at least 90% sequence identity thereto; and/or the beta chain comprises the amino acid sequence set forth in SEQ ID NOs: 57, 85, 111, 134, 154, 177, 203, or 229, or a sequence of amino acids that has at least 90% sequence identity thereto. In some embodiments, the alpha and beta chains comprise the amino acid sequences of SEQ ID NOs: 44 and 57, respectively. In some embodiments, the alpha and beta chains comprise the amino acid sequences of SEQ ID NOs: 74 and 85, respectively. In some embodiments, the alpha and beta chains comprise the amino acid sequences of SEQ ID NOs: 100 and 111, respectively. In some embodiments, the alpha and beta chains comprise the amino acid sequences of SEQ ID NOs: 123 and 134, respectively. In some embodiments, the alpha and beta chains comprise the amino acid sequences of SEQ ID NOs: 146 and 154, respectively. In some embodiments, the alpha and beta chains comprise the amino acid sequences of SEQ ID NOs: 166 and 177, respectively. In some embodiments, the alpha and beta chains comprise the amino acid sequences of SEQ ID NOs: 192 and 202, respectively. In some embodiments, the alpha and beta chains comprise the amino acid sequences of SEQ ID NOs:218 and 229, respectively.

In some of any such embodiments, the Cα region includes the amino acid sequence set forth in SEQ ID NO: 14, 333, 334, 335, 336, 337, 338, 341, 344, 345, 346, 347 or 348, or a sequence of amino acids that has at least 90% sequence identity thereto; and/or the Cβ region includes the amino acid sequence set forth in SEQ ID NO: 29, 339, 340, 342, 343, 350, 351 or 352 or a sequence of amino acids that has at least 90% sequence identity thereto.

In some of any such embodiments, the Cα region comprises the amino acid sequence set forth in SEQ ID NO: 14, or a sequence of amino acids that has at least 90% sequence identity thereto; and/or the Cβ region comprises the amino acid sequence set forth in SEQ ID NO: 29, or a sequence of amino acids that has at least 90% sequence identity thereto. In some of any such embodiments, the Cα region includes the amino acid sequence set forth in SEQ ID NO: 14, or a sequence of amino acids that has at least 90% sequence identity thereto; and/or the Cβ region includes the amino acid sequence set forth in SEQ ID NO: 350, or a sequence of amino acids that has at least 90% sequence identity thereto.

In some of any such embodiments, the introduction of one or more cysteine residues comprises replacement of a non-cysteine residue with a cysteine residue. In some of any such embodiments, the provided TCR or antigen-binding fragment thereof comprises a Cα region comprising a cysteine at a position corresponding to position 48 with numbering as set forth in any of SEQ ID NO: 333-337 or at a position corresponding to position 49 with numbering as set forth in SEQ ID NO: 338 or 341; and/or a Cβ region comprising a cysteine at a position corresponding to position 57 with numbering as set forth in SEQ ID NO: 339 or 340 or at a position corresponding to position 58 with numbering as set forth in SEQ ID NO: 342 or 343.

In certain embodiments: the alpha chain comprises the amino acid sequence set forth in SEQ ID NOs: 43, 73, 99, 122, 145, 165, 191, or 217, or a sequence of amino acids that has at least 90% sequence identity thereto; and/or the beta chain comprises the amino acid sequence set forth in SEQ ID NOs: 56, 84, 110, 133, 153, 176, 202, or 228, or a sequence of amino acids that has at least 90% sequence identity thereto. In some embodiments, the alpha and beta chains comprise the amino acid sequences of SEQ ID NOs: 43 and 56, respectively. In some embodiments, the alpha and beta chains comprise the amino acid sequences of SEQ ID NOs: 73 and 84, respectively. In some embodiments, the alpha and beta chains comprise the amino acid sequences of SEQ ID NOs: 99 and 110, respectively. In some embodiments, the alpha and beta chains comprise the amino acid sequences of SEQ ID NOs: 122 and 133, respectively. In some embodiments, the alpha and beta chains comprise the amino acid sequences of SEQ ID NOs: 145 and 153, respectively. In some embodiments, the alpha and beta chains comprise the amino acid sequences of SEQ ID NOs: 165 and 176, respectively. In some embodiments, the alpha and beta chains comprise the amino acid sequences of SEQ ID NOs: 191 and 201, respectively. In some embodiments, the alpha and beta chains comprise the amino acid sequences of SEQ ID NOs:217 and 228, respectively.

In some of any such embodiments, the alpha chain comprises the amino acid sequence set forth in SEQ ID NOs: 43, 73, 99, 122, 145, 165, 191, or 217, or a sequence of amino acids that has at least 90% sequence identity thereto; and/or the beta chain comprises the amino acid sequence set forth in SEQ ID NOs: 359, 370, 371, 372, 373, 374, 375 or 376, or a sequence of amino acids that has at least 90% sequence identity thereto. In some embodiments, the alpha and beta chains comprise the amino acid sequences of SEQ ID NOs: 43 and 359, respectively. In some embodiments, the alpha and beta chains comprise the amino acid sequences of SEQ ID NOs: 73 and 370, respectively. In some embodiments, the alpha and beta chains comprise the amino acid sequences of SEQ ID NOs: 99 and 371, respectively. In some embodiments, the alpha and beta chains comprise the amino acid sequences of SEQ ID NOs: 122 and 372, respectively. In some embodiments, the alpha and beta chains comprise the amino acid sequences of SEQ ID NOs: 145 and 373, respectively. In some embodiments, the alpha and beta chains comprise the amino acid sequences of SEQ ID NOs: 165 and 374, respectively. In some embodiments, the alpha and beta chains comprise the amino acid sequences of SEQ ID NOs: 191 and 375, respectively. In some embodiments, the alpha and beta chains comprise the amino acid sequences of SEQ ID NOs:217 and 376, respectively.

In particular embodiments, the TCR or antigen-binding fragment comprises: (i) the alpha and beta chains comprising the amino acid sequences of SEQ ID NOs: 44 and 57, respectively; (ii) the alpha and beta chains comprising the amino acid sequence set forth in SEQ ID NO:43 and SEQ ID NO:56, respectively; (iii) the alpha and beta chains comprising the amino acid sequence set forth in SEQ ID NO:43 and SEQ ID NO:359, respectively; or (iv) an alpha and beta chain that independently exhibit at least 90%, 91%, 92%, 93%, 94%, 95%, 96%, 97%, 98%, 99% or more sequence identity to the alpha and beta chain sequences, respectively, in (i) or to the alpha and beta chain sequences, respectively, in (ii), wherein the alpha chain comprises a CDR-1, CDR-2, and CDR-3, comprising the amino acid sequences of SEQ ID NOs: 48, 49, and 50, respectively, and the beta chain comprises a CDR-1, CDR-2, and CDR-3, comprising the amino acid sequences of SEQ ID NOs: 61, 62, and 63.

In some of any such embodiments, the TCR or antigen-binding fragment comprises an alpha and beta chain that independently exhibit at least 90%, 91%, 92%, 93%, 94%, 95%, 96%, 97%, 98%, 99% or more sequence identity to the alpha and beta chain sequences comprising the amino acid sequences of SEQ ID NOs: 43 and 56, respectively, wherein the alpha chain comprises a CDR-1, a CDR-2, and a CDR-3, comprising the amino acid sequences of SEQ ID NOs: 48, 49, and 50, respectively, and the beta chain comprises a CDR-1, a CDR-2, and a CDR-3, comprising the amino acid sequences of SEQ ID NOs: 61, 62, and 63. In some of any such embodiments, the TCR or antigen-binding fragment comprises the alpha and beta chains comprising the amino acid sequences of SEQ ID NOs: 43 and 56, respectively. In some of any such embodiments, the TCR or antigen-binding fragment comprises the alpha and beta chains comprising the amino acid sequences of SEQ ID NOs: 43 and 56, respectively.

In some of any such embodiments, the TCR or antigen-binding fragment comprises an alpha and beta chain that independently exhibit at least 90%, 91%, 92%, 93%, 94%, 95%, 96%, 97%, 98%, 99% or more sequence identity to the alpha and beta chain sequences comprising the amino acid sequences of SEQ ID NOs: 43 and 359, respectively, wherein the alpha chain comprises a CDR-1, a CDR-2, and a CDR-3, comprising the amino acid sequences of SEQ ID NOs: 48, 49, and 50, respectively, and the beta chain comprises a CDR-1, a CDR-2, and a CDR-3, comprising the amino acid sequences of SEQ ID NOs: 61, 62, and 63. In some of any such embodiments, the TCR or antigen-binding fragment comprises the alpha and beta chains comprising the amino acid sequences of SEQ ID NOs: 43 and 359, respectively.

In some of any such embodiments, the TCR or antigen-binding fragment comprises: (i) the alpha and beta chains comprising the amino acid sequences of SEQ ID NOs: 192 and 203, respectively; (ii) the alpha and beta chains comprising the amino acid sequence set forth in SEQ ID NO: 191 and SEQ ID NO:202, respectively; (iii) the alpha and beta chains comprising the amino acid sequences of SEQ ID NO: 191 and SEQ ID NO:375 or (iv) an alpha and beta chain that independently exhibit at least 90%, 91%, 92%, 93%, 94%, 95%, 96%, 97%, 98%, 99% or more sequence identity to the alpha and beta chain sequences, respectively, in (i) or to the alpha and beta chain sequences, respectively, in (ii), wherein the alpha chain comprises a CDR-1, a CDR-2, and a CDR-3, comprising the amino acid sequences of SEQ ID NOs: 196, 197, and 198, respectively, and the beta chain comprises a CDR-1, a CDR-2, and a CDR-3, comprising the amino acid sequences of SEQ ID NOs: 207, 208, and 209, respectively. In some of any such embodiments, the TCR or antigen-binding fragment comprises the alpha and beta chains comprising the amino acid sequence set forth in SEQ ID NO: 191 and SEQ ID NO:375.

In certain embodiments, the TCR or antigen-binding fragment comprises: (i) the alpha and beta chains comprising the amino acid sequences of SEQ ID NOs: 218 and 229, respectively; (ii) the alpha and beta chains comprising the amino acid sequence set forth in SEQ ID NO:217 and SEQ ID NO:228, respectively; or (iii) the alpha and beta chains comprising the amino acid sequences of SEQ ID NOs: 217 and 376, respectively; (iv) an alpha and beta chain that independently exhibit at least 90%, 91%, 92%, 93%, 94%, 95%, 96%, 97%, 98%, 99% or more sequence identity to the alpha and beta chain sequences, respectively, in (i) or to the alpha and beta chain sequences, respectively, in (ii), wherein the alpha chain comprises a CDR-1, a CDR-2, and a CDR-3, comprising the amino acid sequences of SEQ ID NOs: 222, 223, and 224, respectively, and the beta chain comprises a CDR-1, a CDR-2, and a CDR-3, comprising the amino acid sequences of SEQ ID NOs: 233, 234, and 235, respectively. In some of any such embodiments, the TCR or antigen-binding fragment comprises the alpha and beta chains comprising the amino acid sequences of SEQ ID NOs: 217 and 376, respectively.

Provided herein are T cell receptors (TCRs) or antigen-binding fragment thereof, comprising an alpha chain comprising a variable alpha (Vα) region and a beta chain comprising a variable beta (Vβ) region, wherein: the Vα region comprises: a complementarity determining region 1 (CDR-1) comprising an amino acid sequence set forth in SEQ ID NO: 248; a complementarity determining region 2 (CDR-2) comprising an amino acid sequence set forth in SEQ ID NO: 249; and a complementarity determining region 3 (CDR-3) comprising an amino acid sequence set forth in SEQ ID NO: 250; and the Vβ region comprises: a complementarity determining region 1 (CDR-1) comprising an amino acid sequence set forth in SEQ ID NO: 259; a complementarity determining region 2 (CDR-2) comprising an amino acid sequence set forth in SEQ ID NO: 260; and a complementarity determining region 3 (CDR-3) comprising an amino acid sequence set forth in SEQ ID NO: 261. In some of any such embodiments, the Vα region comprises the amino acid sequence set forth in any of SEQ ID NO: 247 or an amino acid sequence that has at least 90%, 91%, 92%, 93%, 94%, 95%, 96%, 97%, 98%, or 99% sequence identity thereto; and/or the Vβ region comprises the amino acid sequence set forth in any of SEQ ID NOs: 258 or an amino acid sequence that has at least 90%, 91%, 92%, 93%, 94%, 95%, 96%, 97%, 98%, or 99% sequence identity thereto. In some of any such embodiments, the TCR or antigen-binding fragment thereof binds to or recognizes a peptide epitope of human papillomavirus (HPV) 16 E6 in the context of an MHC molecule, the peptide epitope is or comprises E6(29-38) TIHDIILECV (SEQ ID NO: 268).

Provided herein is a T cell receptor (TCR) or antigen-binding fragment thereof, comprising an alpha chain comprising a variable alpha (Vα) region and a beta chain comprising a variable beta (Vβ) region, wherein: the Vα region comprises the amino acid sequence set forth in any of SEQ ID NO: 247 or an amino acid sequence that has at least 90%, 91%, 92%, 93%, 94%, 95%, 96%, 97%, 98%, or 99% sequence identity thereto; and/or the Vβ region comprises the amino acid sequence set forth in any of SEQ ID NOs: 258 or an amino acid sequence that has at least 90%, 91%, 92%, 93%, 94%, 95%, 96%, 97%, 98%, or 99% sequence identity thereto. In some of any such embodiments, the TCR or antigen-binding fragment thereof binds to or recognizes a peptide epitope of human papillomavirus (HPV) 16 E6 in the context of an MHC molecule, the peptide epitope is or comprises E6(29-38) TIHDIILECV (SEQ ID NO: 268).

Provided herein is a T cell receptor (TCR) or antigen-binding fragment thereof, comprising an alpha chain comprising a variable alpha (Vα) region and a beta chain comprising a variable beta (Vβ) region, wherein: the Vα region comprises the amino acid sequence set forth in any of SEQ ID NO: 247 or an amino acid sequence that has at least 90%, 91%, 92%, 93%, 94%, 95%, 96%, 97%, 98%, or 99% sequence identity thereto; and the Vβ region comprises the amino acid sequence set forth in any of SEQ ID NOs: 258 or an amino acid sequence that has at least 90%, 91%, 92%, 93%, 94%, 95%, 96%, 97%, 98%, or 99% sequence identity thereto. In some of any such embodiments, the TCR or antigen-binding fragment thereof binds to or recognizes a peptide epitope of human papillomavirus (HPV) 16 E6 in the context of an MHC molecule, the peptide epitope is or comprises E6(29-38) TIHDIILECV (SEQ ID NO: 268).

In particular embodiments: the Vα region comprises the amino acid sequence set forth in any of SEQ ID NO: 247 or an amino acid sequence that has at least 90%, 91%, 92%, 93%, 94%, 95%, 96%, 97%, 98%, or 99% sequence identity thereto; and/or the Vβ region comprises the amino acid sequence set forth in any of SEQ ID NOs: 258 or an amino acid sequence that has at least 93%, 94%, 95%, 96%, 97%, 98%, or 99% sequence identity thereto. In some of any such embodiments, the TCR or antigen-binding fragment thereof binds to or recognizes a peptide epitope of human papillomavirus (HPV) 16 E6 in the context of an MHC molecule, the peptide epitope is or comprises E6(29-38) TIHDIILECV (SEQ ID NO: 268).

In certain embodiments: the Vα region comprises a complementarity determining region 3 (CDR-3) comprising an amino acid sequence set forth in SEQ ID NO: 250, or a CDR3 contained within the amino acid sequence set forth in SEQ ID NO: 247; and/or the Vβ region comprises a complementarity determining region 3 (CDR-3) comprising an amino acid sequence set forth in SEQ ID NO: 261, or a CDR3 contained within the amino acid sequence set forth in SEQ ID NO: 258. In particular embodiments, the Vα region comprises: a complementarity determining region 1 (CDR-1) comprising an amino acid sequence set forth in SEQ ID NO: 248 or a CDR-1 contained within the amino acid sequence set forth in SEQ ID NO: 247; and/or a complementarity determining region 2 (CDR-2) comprising an amino acid sequence set forth in SEQ ID NO: 249 or a CDR-2 contained within the amino acid sequence set forth in SEQ ID NO: 247. In some of any such embodiments, the Vβ region comprises: a complementarity determining region 1 (CDR-1) comprising an amino acid sequence set forth in SEQ ID NO: 259 or a CDR-1 contained within the amino acid sequence set forth in SEQ ID NO: 258; and/or a complementarity determining region 2 (CDR-2) comprising an amino acid sequence set forth in SEQ ID NO: 260 or a CDR-2 contained within the amino acid sequence set forth in SEQ ID NO: 258.

In certain embodiments: the Vα region comprises: a complementarity determining region 1 (CDR-1) comprising an amino acid sequence set forth in SEQ ID NO: 248; a complementarity determining region 2 (CDR-2) comprising an amino acid sequence set forth in SEQ ID NO: 249; and/or a complementarity determining region 3 (CDR-3) comprising an amino acid sequence set forth in SEQ ID NO: 250; and/or the Vβ region comprises: a complementarity determining region 1 (CDR-1) comprising an amino acid sequence set forth in SEQ ID NO: 259; a complementarity determining region 2 (CDR-2) comprising an amino acid sequence set forth in SEQ ID NO: 260; and/or a complementarity determining region 3 (CDR-3) comprising an amino acid sequence set forth in SEQ ID NO: 261.

In particular embodiments: the Vα region comprises a complementarity determining region 1 (CDR-1), a CDR-2, and a CDR-3, respectively comprising the CDR-1, the CDR-2, and the CDR-3 amino acid sequences contained within a Vα region amino acid sequence set forth in SEQ ID NO: 247; and/or the Vβ region comprises a complementarity determining region 1 (CDR-1), a CDR-2, and a CDR-3, respectively comprising the CDR-1, the CDR-2, and the CDR-3 amino acid sequences contained within a Vβ region amino acid sequence set forth in SEQ ID NO: 258. In some of any such embodiments: the Vα region comprises a CDR-1, a CDR-2, and a CDR-3, comprising the amino acid sequences of SEQ ID NOs: 248, 249, and 250, respectively, and the Vβ region comprises a CDR-1, a CDR-2, and a CDR-3, comprising the amino acid sequences of SEQ ID NOs: 259, 260, and 261, respectively. In certain embodiments, the Vα and Vβ regions comprise the amino acid sequences of SEQ ID NOs: 247 and 258, respectively, or an amino acid sequence that has at least 90%, 91%, 92%, 93%, 94%, 95%, 96%, 97%, 98%, or 99% sequence identity thereto. In particular embodiments: the Vα and Vβ regions comprise the amino acid sequences of SEQ ID NOs: 247 and 258, respectively.

In some of any such embodiments, the alpha chain further comprises an alpha constant (Cα) region and/or the beta chain further comprises a beta constant (Cβ) region. In certain embodiments, the Cα and Cβ regions are mouse constant regions. In particular embodiments, the Cα and Cβ regions are human constant regions. In some of any such embodiments, the Cα and/or Cβ regions comprise introduction of one or more cysteine residues that are capable of forming one or more non-native disulfide bridges between the alpha chain and beta chain.

In some of any such embodiments, the Cα region includes the amino acid sequence set forth in SEQ ID NO: 15, 275, 276, 277, 278, 279, 280, 281 or 282, or a sequence of amino acids that has at least 90% sequence identity thereto; and/or the Cβ region includes the amino acid sequence set forth in SEQ ID NO: 30, 283, 284 or 285 or a sequence of amino acids that has at least 90% sequence identity thereto. In certain embodiments: the Cα region comprises the amino acid sequence set forth in SEQ ID NO: 15, or a sequence of amino acids that has at least 90% sequence identity thereto; and/or the Cβ region comprises the amino acid sequence set forth in SEQ ID NO: 30, or a sequence of amino acids that has at least 90% sequence identity thereto.

In particular embodiments: a) the alpha chain comprises the amino acid sequence set forth in SEQ ID NOs: 244, or a sequence of amino acids that has at least 90%, 91%, 92%, 93%, 94%, 95%, 96%, 97%, 98%, 99% sequence identity thereto; and/or the beta chain comprises the amino acid sequence set forth in SEQ ID NOs: 255, or a sequence of amino acids that has at least 90% sequence identity thereto. In some embodiments, the alpha chain comprises a CDR-1, a CDR-2, and a CDR-3, comprising the amino acid sequences of SEQ ID NOs: 248, 249, and 250, respectively, and the beta chain comprises a CDR-1, a CDR-2, and a CDR-3, comprising the amino acid sequences of SEQ ID NOs: 259, 260, and 261, respectively; or b) the alpha and beta chains comprise the amino acid sequences of SEQ ID NOs: 244 and 255, respectively.

In some of any such embodiments, the Cα region includes the amino acid sequence set forth in SEQ ID NO: 14, 333, 334, 335, 336, 337, 338, 341, 344, 345, 346, 347 or 348, or a sequence of amino acids that has at least 90% sequence identity thereto; and/or the Cβ region includes the amino acid sequence set forth in SEQ ID NO: 29, 339, 340, 342, 343, 350, 351 or 352 or a sequence of amino acids that has at least 90% sequence identity thereto.

In some of any such embodiments: the Cα region comprises the amino acid sequence set forth in SEQ ID NO: 14, or a sequence of amino acids that has at least 90% sequence identity thereto; and/or the Cβ region comprises the amino acid sequence set forth in SEQ ID NO: 29, or a sequence of amino acids that has at least 90% sequence identity thereto. In some of any such embodiments, the Cα region comprises the amino acid sequence set forth in SEQ ID NO: 14, or a sequence of amino acids that has at least 90% sequence identity thereto; and/or the Cβ region comprises the amino acid sequence set forth in SEQ ID NO:350, or a sequence of amino acids that has at least 90% sequence identity thereto.

In some of any such embodiments, the introduction of one or more cysteine residues comprises replacement of a non-cysteine residue with a cysteine residue. In some of any such embodiments, the Cα region comprises a cysteine at a position corresponding to position 48 with numbering as set forth in any of SEQ ID NO: 333-337 or at a position corresponding to position 49 with numbering as set forth in SEQ ID NO: 338 or 341; and/or the Cβ region comprises a cysteine at a position corresponding to position 57 with numbering as set forth in SEQ ID NO: 339 or 340 or at a position corresponding to position 58 with numbering as set forth in SEQ ID NO: 342 or 343.

In certain embodiments: a) the alpha chain comprises the amino acid sequence set forth in SEQ ID NOs: 243, or a sequence of amino acids that has at least 90%, 91%, 92%, 93%, 94%, 95%, 96%, 97%, 98%, 99% sequence identity thereto; and/or the beta chain comprises the amino acid sequence set forth in SEQ ID NOs: 254, or a sequence of amino acids that has at least 90% sequence identity thereto. In some embodiments, the alpha chain comprises a CDR-1, a CDR-2, and a CDR-3, comprising the amino acid sequences of SEQ ID NOs: 248, 249, and 250, respectively, and the beta chain comprises a CDR-1, a CDR-2, and a CDR-3, comprising the amino acid sequences of SEQ ID NOs: 259, 260, and 261, respectively; or b) the alpha and beta chains comprise the amino acid sequences of SEQ ID NOs: 243 and 254, respectively.

In some of any such embodiments, the alpha chain comprises the amino acid sequence set forth in SEQ ID NOs: 243, or a sequence of amino acids that has at least 90%, 91%, 92%, 93%, 94%, 95%, 96%, 97%, 98%, 99% sequence identity thereto; and/or the beta chain comprises the amino acid sequence set forth in SEQ ID NOs: 377, or a sequence of amino acids that has at least 90% sequence identity thereto. In some embodiments, the alpha chain comprises a CDR-1, a CDR-2, and a CDR-3, comprising the amino acid sequences of SEQ ID NOs: 248, 249, and 250, respectively, and the beta chain comprises a CDR-1, a CDR-2, and a CDR-3, comprising the amino acid sequences of SEQ ID NOs: 259, 260, and 261, respectively. In some embodiments, the alpha and beta chains comprise the amino acid sequences of SEQ ID NOs: 243 and 377, respectively.

Provided herein are T cell receptors (TCRs) or antigen-binding fragment thereof, comprising an alpha chain comprising a variable alpha (Vα) region and a beta chain comprising a variable beta (Vβ) region, wherein: the Vα region comprises: a complementarity determining region 1 (CDR-1) comprising an amino acid sequence set forth in SEQ ID NO: 10; a complementarity determining region 2 (CDR-2) comprising an amino acid sequence set forth in SEQ ID NO: 11; and/or a complementarity determining region 3 (CDR-3) comprising an amino acid sequence set forth in SEQ ID NO: 12; and/or the Vβ region comprises: a complementarity determining region 1 (CDR-1) comprising an amino acid sequence set forth in SEQ ID NO: 25; a complementarity determining region 2 (CDR-2) comprising an amino acid sequence set forth in SEQ ID NO: 26; and/or a complementarity determining region 3 (CDR-3) comprising an amino acid sequence set forth in SEQ ID NO: 27. In certain embodiments, the TCR or antigen-binding fragment thereof, when expressed on the surface of a T cell, stimulates cytotoxic activity against a target cancer cell. In some embodiments, the target cancer cell contains HPV DNA sequences or expresses HPV 16 and/or optionally wherein the target cancer cell is SCC152.

In some of any such embodiments, the Vα region comprises the amino acid sequence set forth in SEQ ID NO: 9 or an amino acid sequence that has at least 90%, 91%, 92%, 93%, 94%, 95%, 96%, 97%, 98%, or 99% sequence identity thereto; and the Vβ region comprises the amino acid sequence set forth in SEQ ID NOs: 24 or an amino acid sequence that has at least 90%, 91%, 92%, 93%, 94%, 95%, 96%, 97%, 98%, or 99% sequence identity thereto.

Provided herein is T cell receptors (TCRs) or antigen-binding fragment thereof, comprising an alpha chain comprising a variable alpha (Vα) region and a beta chain comprising a variable beta (Vβ) region, wherein: the Vα region comprises the amino acid sequence set forth in any of SEQ ID NO: 9 or an amino acid sequence that has at least 90%, 91%, 92%, 93%, 94%, 95%, 96%, 97%, 98%, or 99% sequence identity thereto; and/or the Vβ region comprises the amino acid sequence set forth in any of SEQ ID NOs: 24 or an amino acid sequence that has at least 90%, 91%, 92%, 93%, 94%, 95%, 96%, 97%, 98%, or 99% sequence identity thereto. In certain embodiments, the TCR or antigen-binding fragment thereof, when expressed on the surface of a T cell, stimulates cytotoxic activity against a target cancer cell. In some embodiments, the target cancer cell contains HPV DNA sequences or expresses HPV 16 and/or optionally wherein the target cancer cell is SCC152.

Provided herein is a T cell receptor (TCR) or antigen-binding fragment thereof, comprising an alpha chain comprising a variable alpha (Vα) region and a beta chain comprising a variable beta (Vβ) region, wherein: the Vα region comprises the amino acid sequence set forth in any of SEQ ID NO: 9 or an amino acid sequence that has at least 90%, 91%, 92%, 93%, 94%, 95%, 96%, 97%, 98%, or 99% sequence identity thereto; and the Vβ region comprises the amino acid sequence set forth in any of SEQ ID NOs: 24 or an amino acid sequence that has at least 90%, 91%, 92%, 93%, 94%, 95%, 96%, 97%, 98%, or 99% sequence identity thereto. In certain embodiments, the TCR or antigen-binding fragment thereof, when expressed on the surface of a T cell, stimulates cytotoxic activity against a target cancer cell. In some embodiments, the target cancer cell contains HPV DNA sequences or expresses HPV 16 and/or optionally wherein the target cancer cell is SCC152.

In some of any such embodiments: the Vα region comprises the amino acid sequence set forth in any of SEQ ID NO: 9 or an amino acid sequence that has at least 90%, 91%, 92%, 93%, 94%, 95%, 96%, 97%, 98%, or 99% sequence identity thereto; and/or the Vβ region comprises the amino acid sequence set forth in any of SEQ ID NOs: 24 or an amino acid sequence that has at least 93%, 94%, 95%, 96%, 97%, 98%, or 99% sequence identity thereto. In certain embodiments, the TCR or antigen-binding fragment thereof, when expressed on the surface of a T cell, stimulates cytotoxic activity against a target cancer cell. In some embodiments, the target cancer cell contains HPV DNA sequences or expresses HPV 16 and/or optionally wherein the target cancer cell is SCC152.

In particular embodiments: the Vα region comprises a complementarity determining region 3 (CDR-3) comprising an amino acid sequence set forth in SEQ ID NO: 12, or a CDR3 contained within the amino acid sequence set forth in SEQ ID NO: 9; and/or the Vβ region comprises a complementarity determining region 3 (CDR-3) comprising an amino acid sequence set forth in SEQ ID NO: 27, or a CDR3 contained within the amino acid sequence set forth in SEQ ID NO: 24. In some of any such embodiments, the Vα region comprises: a complementarity determining region 1 (CDR-1) comprising an amino acid sequence set forth in SEQ ID NO: 10 or a CDR-1 contained within the amino acid sequence set forth in SEQ ID NO: 9; and/or a complementarity determining region 2 (CDR-2) comprising an amino acid sequence set forth in SEQ ID NO: 11 or a CDR-2 contained within the amino acid sequence set forth in SEQ ID NO: 9. In certain embodiments, the Vβ region comprises: a complementarity determining region 1 (CDR-1) comprising an amino acid sequence set forth in SEQ ID NO: 25 or a CDR-1 contained within the amino acid sequence set forth in SEQ ID NO: 24; and/or a complementarity determining region 2 (CDR-2) comprising an amino acid sequence set forth in SEQ ID NO: 26 or a CDR-2 contained within the amino acid sequence set forth in SEQ ID NO: 24.

In particular embodiments: the Vα region comprises: a complementarity determining region 1 (CDR-1) comprising an amino acid sequence set forth in SEQ ID NO: 10; a complementarity determining region 2 (CDR-2) comprising an amino acid sequence set forth in SEQ ID NO: 11; and/or a complementarity determining region 3 (CDR-3) comprising an amino acid sequence set forth in SEQ ID NO: 12; and/or the Vβ region comprises: a complementarity determining region 1 (CDR-1) comprising an amino acid sequence set forth in SEQ ID NO: 25; a complementarity determining region 2 (CDR-2) comprising an amino acid sequence set forth in SEQ ID NO: 26; and/or a complementarity determining region 3 (CDR-3) comprising an amino acid sequence set forth in SEQ ID NO: 27.

In some of any such embodiments: the Vα region comprises a complementarity determining region 1 (CDR-1), a CDR-2, and a CDR-3, respectively comprising the CDR-1, the CDR-2, and the CDR-3 amino acid sequences contained within a Vα region amino acid sequence set forth in SEQ ID NO: 9; and/or the Vβ region comprises a complementarity determining region 1 (CDR-1), a CDR-2, and a CDR-3, respectively comprising the CDR-1, the CDR-2, and the CDR-3 amino acid sequences contained within a Vβ region amino acid sequence set forth in SEQ ID NO: 24. In certain embodiments: the Vα region comprises a CDR-1, a CDR-2, and a CDR-3, comprising the amino acid sequences of SEQ ID NOs: 10, 11, and 12, respectively, and the Vβ region comprises a CDR-1, a CDR-2, and a CDR-3, comprising the amino acid sequences of SEQ ID NOs: 25, 26, and 27, respectively. In particular embodiments, the Vα and Vβ regions comprise the amino acid sequences of SEQ ID NOs: 9 and 24, respectively, or an amino acid sequence that has at least 90%, 91%, 92%, 93%, 94%, 95%, 96%, 97%, 98%, or 99% sequence identity thereto. In some of any such embodiments, the Vα and Vβ regions comprise the amino acid sequences of SEQ ID NOs: 9 and 24, respectively.

In certain embodiments, the alpha chain further comprises an alpha constant (Cα) region and/or the beta chain further comprises a beta constant (Cβ) region. In particular embodiments, the Cα and Cβ regions are mouse constant regions. In some of any such embodiments, the Cα and Cβ regions are human constant regions. In certain embodiments, the Cα and/or Cβ regions comprise introduction of one or more cysteine residues that are capable of forming one or more non-native disulfide bridges between the alpha chain and beta chain. In some of any such embodiments, the Cα region includes the amino acid sequence set forth in SEQ ID NO: 15, 275, 276, 277, 278, 279, 280, 281 or 282, or a sequence of amino acids that has at least 90% sequence identity thereto; and/or the Cβ region includes the amino acid sequence set forth in SEQ ID NO: 30, 283, 284 or 285 or a sequence of amino acids that has at least 90% sequence identity thereto.

In particular embodiments: the Cα region comprises the amino acid sequence set forth in SEQ ID NO: 15, or a sequence of amino acids that has at least 90% sequence identity thereto; and/or the Cβ region comprises the amino acid sequence set forth in SEQ ID NO: 30, or a sequence of amino acids that has at least 90% sequence identity thereto.

In some of any such embodiments: a) the alpha chain comprises the amino acid sequence set forth in SEQ ID NOs: 6, or a sequence of amino acids that has at least 90%, 91%, 92%, 93%, 94%, 95%, 96%, 97%, 98%, 99% sequence identity thereto; and/or the beta chain comprises the amino acid sequence set forth in SEQ ID NOs: 21, or a sequence of amino acids that has at least 90% sequence identity thereto. In some embodiments, the alpha chain comprises a CDR-1, a CDR-2, and a CDR-3, comprising the amino acid sequences of SEQ ID NOs: 10, 11, and 12, respectively, and the beta chain comprises a CDR-1, a CDR-2, and a CDR-3, comprising the amino acid sequences of SEQ ID NOs: 25, 26, and 27, respectively; or b) the alpha and beta chains comprise the amino acid sequences of SEQ ID NOs: 6 and 21, respectively.

In some of any such embodiments, the Cα region includes the amino acid sequence set forth in SEQ ID NO: 14, 333, 334, 335, 336, 337, 338, 341, 344, 345, 346, 347 or 348, or a sequence of amino acids that has at least 90% sequence identity thereto; and/or the Cβ region includes the amino acid sequence set forth in SEQ ID NO: 29, 339, 340, 342, 343, 350, 351 or 352 or a sequence of amino acids that has at least 90% sequence identity thereto.

In certain embodiments: the Cα region comprises the amino acid sequence set forth in SEQ ID NO: 14, or a sequence of amino acids that has at least 90% sequence identity thereto; and/or the Cβ region comprises the amino acid sequence set forth in SEQ ID NO: 29, or a sequence of amino acids that has at least 90% sequence identity thereto. In some of any such embodiments, the Cα region comprises the amino acid sequence set forth in SEQ ID NO: 14, or a sequence of amino acids that has at least 90% sequence identity thereto; and/or the Cβ region comprises the amino acid sequence set forth in SEQ ID NO: 350, or a sequence of amino acids that has at least 90% sequence identity thereto.

In some of any such embodiments, the introduction of one or more cysteine residues comprises replacement of a non-cysteine residue with a cysteine residue. In some of any such embodiments, the Cα region comprises a cysteine at a position corresponding to position 48 with numbering as set forth in any of SEQ ID NO: 333-337 or at a position corresponding to position 49 with numbering as set forth in SEQ ID NO: 338 or 341; and/or the Cβ region comprises a cysteine at a position corresponding to position 57 with numbering as set forth in SEQ ID NO: 339 or 340 or at a position corresponding to position 58 with numbering as set forth in SEQ ID NO: 342 or 343.

In particular embodiments: a) the alpha chain comprises the amino acid sequence set forth in SEQ ID NOs: 5, or a sequence of amino acids that has at least 90%, 91%, 92%, 93%, 94%, 95%, 96%, 97%, 98%, 99% sequence identity thereto; and/or the beta chain comprises the amino acid sequence set forth in SEQ ID NOs: 20, or a sequence of amino acids that has at least 90% sequence identity thereto. In some embodiments, the alpha chain comprises a CDR-1, a CDR-2, and a CDR-3, comprising the amino acid sequences of SEQ ID NOs: 10, 11, and 12, respectively, and the beta chain comprises a CDR-1, a CDR-2, and a CDR-3, comprising the amino acid sequences of SEQ ID NOs: 25, 26, and 27, respectively; or b) the alpha and beta chains comprise the amino acid sequences of SEQ ID NOs: 5 and 20, respectively.

In some of any such embodiments, a) the alpha chain comprises the amino acid sequence set forth in SEQ ID NOs: 5, or a sequence of amino acids that has at least 90%, 91%, 92%, 93%, 94%, 95%, 96%, 97%, 98%, 99% sequence identity thereto; and/or the beta chain comprises the amino acid sequence set forth in SEQ ID NOs: 369, or a sequence of amino acids that has at least 90% sequence identity thereto, optionally wherein the alpha chain comprises a CDR-1, a CDR-2, and a CDR-3, comprising the amino acid sequences of SEQ ID NOs: 10, 11, and 12, respectively, and the beta chain comprises a CDR-1, a CDR-2, and a CDR-3, comprising the amino acid sequences of SEQ ID NOs: 25, 26, and 27, respectively; or b) the alpha and beta chains comprise the amino acid sequences of SEQ ID NOs: 5 and 369, respectively.

In some of any such embodiments, the TCR or antigen-binding fragment thereof is encoded by a nucleotide sequence that has been codon-optimized. In certain embodiments, the alpha and/or beta chain further comprises a signal peptide. In particular embodiments, the TCR or antigen-binding fragment thereof is isolated or purified or is recombinant. In some of any such embodiments, the TCR or antigen-binding fragment is recombinant. In some of any such embodiments, the TCR or antigen-binding fragment thereof is human. In certain embodiments, the TCR or antigen-binding fragment thereof is monoclonal. In particular embodiments, the TCR or antigen-binding fragment thereof is single chain. In some of any such embodiments, the TCR or antigen-binding fragment thereof comprises two chains.

In certain embodiments, the antigen-specificity is at least partially CD8-independent.

In particular embodiments, the MHC molecule is an HLA-A2 molecule.

Provided herein is a nucleic acid molecule encoding any of the provided TCRs or antigen-binding fragment thereof, or an alpha or beta chain thereof. In some of any such embodiments, the nucleotide sequence is codon-optimized. In certain embodiments, the nucleotide sequence encoding the alpha chain and the nucleotide sequence encoding the beta chain are separated by a peptide sequence that causes ribosome skipping. In some of any such embodiments, the peptide that causes ribosome skipping is a P2A or T2A peptide and/or comprises the sequence of amino acids set forth in SEQ ID NO: 32 or 302. In particular embodiments, the nucleic acid is synthetic. In some of any such embodiments, the nucleic acid is cDNA.

Provided herein is a vector comprising a nucleic acid of any provided herein. In certain embodiments, the vector is an expression vector. In particular embodiments, the vector is a viral vector. In some of any such embodiments, the viral vector is a retroviral vector. In certain embodiments, the viral vector is a lentiviral vector. In particular embodiments, the lentiviral vector is derived from HIV-1.

Provided herein is an engineered cell comprising the nucleic acid molecule of any provided herein or vector of any of provided herein. Also provided herein is an engineered cell, comprising the TCR or antigen-binding fragment thereof of any provided herein. In some of any such embodiments, the TCR or antigen-binding fragment thereof is heterologous to the cell. In certain embodiments, the engineered cell is a cell line. In particular embodiments, the engineered cell is a primary cell obtained from a subject. In some of any such embodiments, the subject is a mammalian subject. In certain embodiments, the subject is a human. In particular embodiments, the engineered cell is a T cell. In some of any such embodiments, the T cell is CD8+. In certain embodiments, the T cell is CD4+. In some of any such embodiments, the cell is a human cell.

In some of any such embodiments, the TCR or antigen-binding fragment thereof includes a human alpha constant (Cα) region and a human beta constant (Cβ) region and the engineered cell includes or expresses an endogenous human TCR. In some of any such embodiments, the Vα region includes a CDR-1, a CDR-2, and a CDR-3, including the amino acid sequences of SEQ ID NOs: 48, 49, and 50, respectively, and the Vβ region contains a CDR-1, a CDR-2, and a CDR-3, including the amino acid sequences of SEQ ID NOs: 61, 62, and 63. In some of any such embodiments, the Vα region of the TCR or antigen-binding fragment thereof comprises the amino acid sequence set forth in SEQ ID NO: 47 or an amino acid sequence that has at least 90%, 91%, 92%, 93%, 94%, 95%, 96%, 97%, 98%, or 99% sequence identity thereto; and the Vβ region comprises the amino acid sequence set forth in SEQ ID NOs: 60, or an amino acid sequence that has at least 90%, 91%, 92%, 93%, 94%, 95%, 96%, 97%, 98%, or 99% sequence identity thereto. In some of any such embodiments, the Vα and Vβ regions of the TCR or antigen-binding fragment thereof comprise the amino acid sequences of SEQ ID NOs: 47 and 60, respectively. In some of any such embodiments, the Cα region of the TCR or antigen-binding fragment thereof comprises the amino acid sequence set forth in SEQ ID NO: 14, or a sequence of amino acids that has at least 90% sequence identity thereto; and/or the Cβ region of the TCR or antigen-binding fragment thereof comprises the amino acid sequence set forth in SEQ ID NO: 350, or a sequence of amino acids that has at least 90% sequence identity thereto.

Provided herein are engineered cells containing a recombinant human TCR containing a human alpha constant (Cα) region and a human beta constant (Cβ) region, and the engineered cell includes or expresses an endogenous human TCR. In some of any such embodiments, the recombinant human TCR includes a Vα region containing a CDR-1, a CDR-2, and a CDR-3, including the amino acid sequences of SEQ ID NOs: 48, 49, and 50, respectively, and a Vβ region containing a CDR-1, a CDR-2, and a CDR-3, including the amino acid sequences of SEQ ID NOs: 61, 62, and 63. In some of any such embodiments, the Vα region of the TCR or antigen-binding fragment thereof comprises the amino acid sequence set forth in SEQ ID NO: 47 or an amino acid sequence that has at least 90%, 91%, 92%, 93%, 94%, 95%, 96%, 97%, 98%, or 99% sequence identity thereto; and the Vβ region comprises the amino acid sequence set forth in SEQ ID NOs: 60, or an amino acid sequence that has at least 90%, 91%, 92%, 93%, 94%, 95%, 96%, 97%, 98%, or 99% sequence identity thereto. In some of any such embodiments, the Vα and Vβ regions of the TCR or antigen-binding fragment thereof comprise the amino acid sequences of SEQ ID NOs: 47 and 60, respectively. In some of any such embodiments, the Cα region of the TCR or antigen-binding fragment thereof comprises the amino acid sequence set forth in SEQ ID NO: 14, or a sequence of amino acids that has at least 90% sequence identity thereto; and/or the Cβ region of the TCR or antigen-binding fragment thereof comprises the amino acid sequence set forth in SEQ ID NO: 350, or a sequence of amino acids that has at least 90% sequence identity thereto.

In particular embodiments, the engineered cell comprises a genetic disruption of a T cell receptor alpha constant (TRAC) gene and/or a T cell receptor beta constant (TRBC) gene. In some of any such embodiments, the TRBC gene is one or both of a T cell receptor beta constant 1 (TRBC1) or T cell receptor beta constant 2 (TRBC2) gene.

Provided herein is a method for producing a cell of any of the provided embodiments, comprising introducing any of the provided vectors into a cell in vitro or ex vivo. In certain embodiments, the vector is a viral vector and the introducing is carried out by transduction. In particular embodiments, the method further comprises introducing into the cell one or more agent, wherein each of the one or more agent is independently capable of inducing a genetic disruption of a T cell receptor alpha constant (TRAC) gene and/or a T cell receptor beta constant (TRBC) gene. In some of any such embodiments, the one or more agent capable of inducing a genetic disruption comprises a DNA binding protein or DNA-binding nucleic acid that specifically binds to or hybridizes to the target site.

In certain embodiments, the one or more agent capable of inducing a genetic disruption comprises (a) a fusion protein comprising a DNA-targeting protein and a nuclease or (b) an RNA-guided nuclease. In particular embodiments, the DNA-targeting protein or RNA-guided nuclease comprises a zinc finger protein (ZFP), a TAL protein, or a clustered regularly interspaced short palindromic nucleic acid (CRISPR)-associated nuclease (Cas) specific for a target site within the TRAC and/or TRBC gene. In some of any such embodiments, the one or more agent comprises a zinc finger nuclease (ZFN), a TAL-effector nuclease (TALEN), or and a CRISPR-Cas9 combination that specifically binds to, recognizes, or hybridizes to the target site. In certain embodiments, the each of the one or more agent comprises a guide RNA (gRNA) having a targeting domain that is complementary to the at least one target site. In particular embodiments, the one or more agent is introduced as a ribonucleoprotein (RNP) complex comprising the gRNA and a Cas9 protein. In some of any such embodiments, the RNP is introduced via electroporation, particle gun, calcium phosphate transfection, cell compression or squeezing. In certain embodiments, the RNP is introduced via electroporation. In particular embodiments, the one or more agent is introduced as one or more polynucleotide encoding the gRNA and/or a Cas9 protein.

Provided herein is a composition comprising any of the engineered cells described herein. In some of any such embodiments, the engineered cells comprise CD4+ and/or CD8+ T cells. In certain embodiments, the engineered cells comprise CD4+ and CD8+ T cells. Also provided herein is a composition, comprising an engineered CD8+ cell described herein and an engineered CD4+ cell described herein. In particular embodiments, the TCR or antigen-binding fragment thereof binds to or recognizes a peptide epitope of HPV 16 in the context of an MHC molecule that is at least partially CD8-independent.

In some of any such embodiments, the CD8+ cell and CD4+ cell are engineered with the same TCR or antigen-binding fragment thereof and/or are each engineered with a TCR or antigen-binding fragment thereof that binds to or recognizes the same peptide epitope of HPV 16 in the context of an MHC molecule. In certain embodiments, the composition further comprises a pharmaceutically acceptable excipient.

Provided herein is a method of treatment, comprising administering any of the provided engineered cells to a subject having a disease or disorder associated with HPV. Also provided herein is a method of treatment, comprising administering any of the provided composition to a subject having a disease or disorder associated with HPV. In particular embodiment, the disease or disorder is associated with HPV 16. In particular embodiments, the disease or disorder is cancer.

Provided herein is a method of treatment, comprising administering the engineered cell of described herein to a subject having a disease or disorder associated with HPV. Also provided herein is a method of treatment, comprising administering a composition described herein to a subject having a cancer. Provided herein is one of any of a composition described herein for use in treating a disease or disorder associated with HPV in a subject.

Provided herein is a use of a composition of for the manufacture of a medicament for treating a disease or disorder associated with HPV in a subject. In some of any such embodiments, the disease or disorder is associated with HPV16. In particular embodiments, the disease or disorder is cancer. Also provided herein is a composition described herein for use in treating a cancer in a subject. Also provided herein is a use of any of a composition described herein for the manufacture of a medicament for treating a cancer in a subject. In particular embodiments, the subject is a human.

BRIEF DESCRIPTION OF THE DRAWINGS

FIG. 5A shows the mean tumor volume and FIG. 5B shows tumor volume of individual mice per group.

FIGS. 6A-6B depict cell surface expression of Vbeta, CD8 and MHC/E7(11-19) peptide tetramer binding in primary human CD4+ and CD8+ T cells expressing recombinant TCR 57 or a reference TCR (E7 Ref), as assessed by flow cytometry and compared to mock control (FIG. 6A). FIG. 6B depicts the percentage of Vbeta positive CD8+ and CD4+ T cells for each group.

FIGS. 7B-7D depict cytolytic activity of CD4+(FIG. 7B and FIG. 7C) and CD8+(FIG. 7B and FIG. 7D) T cells expressing recombinant TCR 57 or a reference TCR (E7 Ref), as represented by the area under the curve (AUC) of the percentage of target cell killing after co-culture with various NucLight Red (NLR)-labeled target cells expressing HPV 16 E7 (SCC152, SCC090, CaSKi).

DETAILED DESCRIPTION

Figure 1:
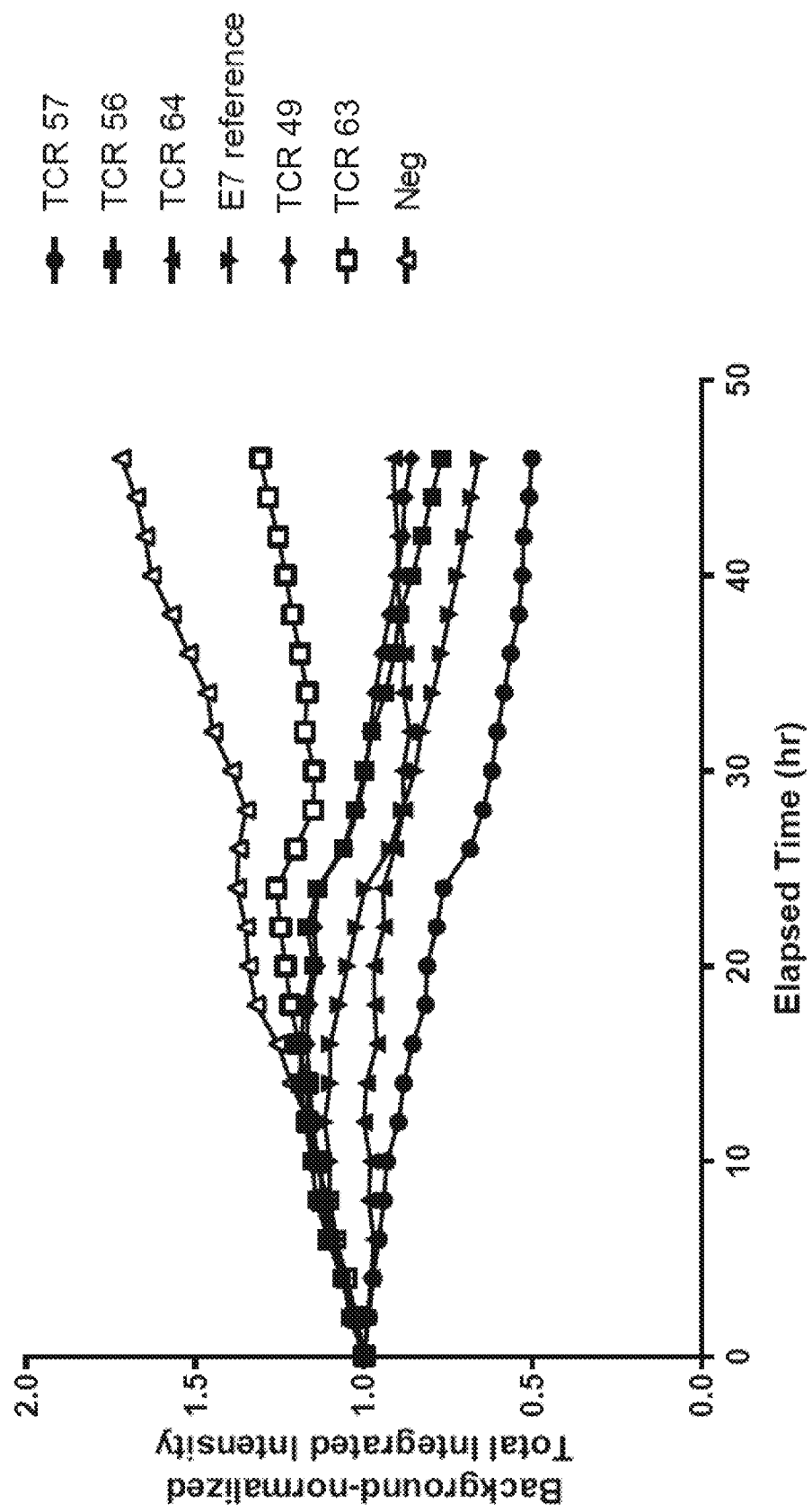
FIG. 1 shows lytic activity of TCR transduced primary T cells incubated with SCC152 target cells based on the loss of viable target cells at various assessed time points.

Among the provided embodiments are binding molecules, such as T cell receptors (TCR), e.g., those that bind or recognize a peptide epitope associated with a cancer antigen, such as a peptide epitope expressed on the surface of a cancer cell and/or a cell infected with human papillomavirus (HPV) or that contains HPV DNA sequences, in the context of an MHC molecule. Among the provided embodiments are approaches useful in the treatment of such diseases and conditions and/or for targeting such cell types, such as cancer cells or cells that are infected with HPV. In some embodiments, the provided binding molecules, such as TCRs, bind or recognize a peptide epitope of HPV 16 E6 or E7, in the context of an MHC molecule. Such binding molecules include T cell receptors (TCRs) and antigen-binding fragments thereof and antibodies and antigen binding fragments thereof that exhibit specifically bind or recognize peptide epitopes of HPV 16 E6 or E7.

Also provided are nucleic acid molecules encoding the binding molecules, engineered cells containing the binding molecules, compositions containing the binding molecules or cells, and methods of treatment involving administering such binding molecules, engineered cells or compositions, and uses of such binding molecules, cells or compositions. In some aspects, engineered cells that express a provided binding molecule, e.g. a TCR or antigen-binding fragment thereof, exhibit cytotoxic activity against target cells expressing the peptide epitope, such as cancer cells or cells that are infected with HPV.

Adoptive cell therapies (including those involving the administration of cells expressing recombinant receptors or binding molecules specific for a disease or disorder of interest, such as a recombinant T cell receptor (TCR) and/or other recombinant antigen receptors, such as chimeric antigen receptors, as well as other adoptive immune cell and adoptive T cell therapies) can be effective in the treatment of cancer and other diseases and disorders. In certain contexts, available approaches to adoptive cell therapy may not always be entirely satisfactory. In some contexts, optimal efficacy can depend on the ability of the administered cells to express the recombinant receptor, and for the recombinant receptor to recognize and bind to a target, e.g., target antigen, such as peptide epitopes of HPV 16 E6 or E7, within the subject, tumors, and environments thereof, and for uniform, homogenous and/or consistent expression of the receptors among cells, such as a population of immune cells and/or cells in a therapeutic cell composition.

In some contexts, optimal response to therapy can depend on the ability of the engineered recombinant receptors such as TCRs, to be consistently and reliably expressed on the surface of the cells and/or bind the target antigen. For example, in some cases, properties of certain recombinant receptors, e.g., TCRs, can affect the expression and/or activity of the recombinant receptor, in some cases when expressed in a cell, such as a human T cell, used in cell therapy. In some contexts, the level of expression of particular recombinant receptors, e.g., TCRs, can be low, and activity of the engineered cells, such as human T cells, expressing such recombinant receptors, may be limited due to poor expression or poor signaling activity. In some cases, consistency and/or efficiency of expression of the recombinant receptor, and activity of the receptor is limited in certain cells or certain cell populations of available therapeutic approaches. In some cases, a large number of engineered T cells (a high effector to target (E:T) ratio) is required to exhibit functional activity.

In some aspects, development of a humanized and/or fully human recombinant TCR presents technical challenges. For example, in some aspects, a humanized and/or a fully human recombinant TCR receptor, when engineered into a human T cell, competes with endogenous TCR complexes and/or can form mispairings with endogenous TCRα and/or TCRβ chains, which may, in certain aspects, reduce recombinant TCR signaling, activity, and/or expression, and ultimately result in reduced activity of the engineered cells. For example, in some cases, suboptimal expression of an engineered or recombinant TCR can occur due to competition with an endogenous TCR and/or with TCRs having mispaired chains, for signaling molecules and/or domains such as the invariant CD3 signaling molecules (e.g., availability of co-expressed co-expression of CD3 δ, ε, γ and ζ chains) that are involved in permitting expression of the complex on the cell surface. In some aspects, available CD3ζ molecules can limit the expression and function of the TCRs in the cells.

In some contexts, certain available recombinant receptors, such as TCRs, may exhibit poor expression or activity in part due to mispairing and/or competition with endogenous TCR chains and/or other factors. In some cases, a negative impact of endogenous human TCR chain(s) has been observed for certain TCRs, including in connection with expression, activity and/or function of such recombinant TCRs when expressed in human T cells.

One method to address these challenges has been to design recombinant TCRs with mouse constant domains to prevent mispairings with endogenous human TCRα or TCRβ chains. For example, certain reference TCRs as described in International PCT Publication No. WO 2015/184228 have been engineered by employing a mouse constant regions in combination with the reference TCR variable regions in order to avoid such problems. However, use of recombinant TCRs with mouse sequences may, in some aspects, present a risk for immune response. Other approaches to address these challenges include introducing a genetic disruption, e.g., by gene editing, at an endogenous gene encoding one or more TCR chains.

In some aspects, compared to other available recombinant TCRs, among provided recombinant TCRs are TCRs that permit similar or improved expression and/or activity, without the need to employ approaches such as engineering with mouse constant domains and/or introducing a genetic disruption at the endogenous genes encoding one or more TCR chains. In some aspects, the provided embodiments are based on observations of improved expression and activity of certain fully human recombinant TCR, such as certain provided TCRs specific to HPV E7, without employing a mouse constant domains or introducing a genetic disruption at an endogenous TCR-encoding gene. In some aspects, the provided recombinant TCRs, including the exemplary TCR, are fully human TCRs containing human constant domains. In some aspects, the provided embodiments offer an advantage of recombinant TCRs that exhibit high and consistent expression and improved functional activity even in the presence of the endogenous TCR in the human T cell.

In some embodiments, the provided fully human include introducing a genetic disruption, e.g., by gene editing, at an endogenous gene encoding one or more TCR chains. In some cases, such an additional approach may further improve one or more activities of the engineered cells.

In some aspects, the provided recombinant TCRs include TCRs that are at least partially CD8-independent. In some cases, TCR recognition of a peptide in the context of an MHC molecule and subsequent T cell activation is facilitated in the presence of a CD8 co-receptor. For example, CD8 co-receptor engagement can facilitate low- to moderate-TCR affinity interactions and/or T cell activation (See, for example, Kerry et al. J. Immunology (2003) 171(9): 4493-4503 and Robbins et al. J Immunology (2008) 180(9): 6116-6131). Among the provided binding molecules are molecules, e.g. TCRs, that exhibit CD8-independent binding for an HPV E6 or E7 peptide epitope. Such binding molecules, e.g. TCR, may provide an advantage of higher functional avidity or affinity than TCRs or antigen binding fragments thereof that require the presence of CD8 co-expression. In some aspects, the provided CD8-independent binding molecules, such as TCRs, can be expressed or engineered in cells, e.g. T cells, that do not express CD8, such as can be expressed or engineered in CD4+ cells. In some aspects, CD4+ cells engineered with provided TCRs exhibit functional activity, without the requirement of the CD8 co-receptor. In particular embodiments, the provided embodiments permit generation of compositions containing TCR-engineered CD4+ T cells, TCR-engineered CD8+ T cells, or TCR-engineered CD4+ T cells and TCR-engineered CD8+ T cells. The engineered CD4+ and engineered CD8+ T cells can be provided as separate composition or can be formulated or generated in the same composition, such as at a particular ratio of CD4+ cells or an engineered subset thereof to CD8+ T cells or an engineered subset thereof, e.g. at a ratio of 1:3 to 3:1, such as a ratio of 1:2 to 2:1, for example at or about 1:1. In some embodiments, a CD3+ T cell composition can be engineered containing CD4+ and CD8+ T cells expressing a provided TCR.

In some aspects, the provided embodiments are based on observations of improved expression and activity of an exemplary fully human recombinant TCR, such as certain provided TCRs specific to HPV E7, even at a low effector to target (E:T) ratio. The activity of the engineered T cells expressing a recombinant receptor, e.g., cytolytic activity, in some cases may be limited when fewer engineered T cells are present compared to the target cells (e.g., cancer cells expressing the antigen). In some aspects, such improvements in activity, particularly at a low E:T ratio and using fully human sequences, are advantageous in improving the efficacy of the therapy, e.g., adoptive cell therapy.

In some cases, certain available approaches to obtain antigen-specific recombinant receptors, such as recombinant TCRs, can result in recombinant receptors that exhibit cross reactivity to a different, non-target antigen (see, e.g., Cameron et al., (2013) Science Translational Medicine, 5(197): 197ra103). In some aspects, the provided embodiments are based on observations that as described herein, among provided TCRs are fully human recombinant TCR, such as certain provided TCRs specific to HPV E7, that do not show cross reactivity to cells expressing other peptide antigens or alloreactivity to other human leukocyte antigen (HLA) subtypes. The provided TCRs thus exhibit improved expression and activity, with minimal risk of cross reactivity to other antigens, such as non-target antigens, that can be present in the subject, or peptide epitopes present on non-target HLA subtypes.

In some aspects, therapeutic approaches using such TCRs, for example adoptive cell therapy with engineered human T cells expressing the provided recombinant TCRs, can ultimately result in high efficacy, while minimizing the risk of immunogenicity from using mouse constant regions or risks from cross-reactivity or off-target reactivity. In some cases, such efficacy can be achieved without requiring additional engineering steps of the cells, although additional engineering can be further used, in some cases, to further improve one or more activities. In some contexts, the provided embodiments, including the recombinant receptors, polynucleotides encoding such receptors, engineered cells and cell compositions, can provide various advantages over available therapies with recombinant receptors, to improve the activity of the recombinant receptors and response to adoptive cell therapies targeting cancers associated with HPV.

All publications, including patent documents, scientific articles and databases, referred to in this application are incorporated by reference in their entirety for all purposes to the same extent as if each individual publication were individually incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

I. T CELL RECEPTORS AND BINDING MOLECULES

Provided herein are binding molecules, such as those that bind or recognize a peptide epitope associated with a cancer antigen, such as a peptide epitope expressed on the surface of a cancer cell and/or a cell infected with human papillomavirus (HPV) or that contains HPV DNA sequences, in the context of an MHC molecule. In some embodiments, the provided binding molecules bind or recognize a peptide epitope of HPV 16 E6 or E7, in the context of an MHC molecule. In some embodiments, the binding molecules bind or recognize a peptide epitope of an antigen expressed on the surface of a cancer cell or an immortal cell line, such as the exemplary cell line SCC152. Such binding molecules include T cell receptors (TCRs) and antigen-binding fragments thereof and antibodies and antigen binding fragments thereof that exhibit antigenic specificity for binding or recognizing such peptide epitopes. Also provided in some embodiments are nucleic acid molecules encoding the binding molecules, engineered cells containing the binding molecules, compositions and methods of treatment involving administering such binding molecules, engineered cells or compositions. In some aspects, engineered cells that express a provided binding molecule, e.g. a TCR or antigen-binding fragment, exhibit cytotoxic activity against target cells expressing the peptide epitope, such as cancer cells or cells that are infected with HPV or that contain HPV DNA sequences, e.g. the exemplary cell line SCC152.

HPV is a causative organism in most cases of cervical cancer and has been implicated in anal, vaginal, vulvar, penile, and oropharyngeal cancers, and other cancers. Generally, the HPV genome contains an early region containing six open reading frames (E1, E2, E4, E5, E6 and E7), which encode proteins involved in cell transformation and replication, and a late region containing two open reading frames (L1 and L2), which encode proteins of the viral capsid. In general, E6 and E7 are oncogenes that can affect cell cycle regulation and contribute to the formation of cancers. For instance, the E6 gene product can cause p53 degradation and the E7 gene product can cause retinoblastoma (Rb) inactivation.

In some aspects, a provided binding molecule, including a TCR or antigen binding fragment thereof or an antibody, e.g., antibody fragments thereof, and proteins such as chimeric molecules containing one or more of the foregoing, such as the chimeric receptors, e.g., TCR-like CARs, and/or engineered cells expressing the TCRs or CARs, bind to a peptide epitope derived from HPV16 E6 protein, HPV16 E7 protein and/or to a peptide epitope expressed on a cell infected with HPV. In some embodiments, the binding molecule is an anti-HPV-16 binding molecule, such as an anti-HPV16 E6 binding molecule or anti-HPV16 E7 binding molecule.

In some aspects, the binding molecule recognizes or binds HPV 16 E6 or E7 epitopes in the context of an MHC molecule, such as an MHC Class I molecule. In some aspects, the MHC Class I molecule is a human leukocyte antigen (HLA)-A2 molecule, including any one or more subtypes thereof, e.g. HLA-A*0201, *0202, *0203, *0206, or *0207. In some cases, there can be differences in the frequency of subtypes between different populations. For example, in some embodiments, more than 95% of the HLA-A2 positive Caucasian population is HLA-A*0201, whereas in the Chinese population the frequency has been reported to be approximately 23% HLA-A*0201, 45% HLA-A*0207, 8% HLA-A*0206 and 23% HLA-A*0203. In some embodiments, the MHC molecule is HLA-A*0201.

In some embodiments, the TCR or antigen-binding fragment thereof recognizes or binds to an epitope or region of HPV16 E6 or HPV 16 E7, such as a peptide epitope containing an amino acid sequence set forth in any of SEQ ID NOs: 267-274, and as shown below in Table 1.

TABLE 1

HPV-16 Epitopes

| Epitope Description | Epitope Name | SEQ ID NO. |
|---|---|---|
| KLPQLCTEL | E6(18-26) | 267 |
| TIHDIILECV | E6(29-38) | 268 |
| FAFRDLCIV | E6(52-60) | 269 |
| TLGIVCPI | E7(86-93) | 270 |
| YMLDLQPET | E7(11-19) | 271 |
| GTLGIVCPI | E7(85-93) | 272 |
| LLMGTLGIV | E7(82-90) | 273 |
| TLHEYMLDL | E7(7-15) | 274 |

In some embodiments, the binding molecule, e.g., TCR or antigen-binding fragment thereof or antibody or antigen-binding fragment thereof, is isolated or purified or is recombinant. In particular embodiments, any of the provided binding molecules, e.g. TCRs or antigen-binding fragments thereof or antibody or antigen-binding fragments thereof, are recombinant. In some aspects, the binding molecule, e.g., TCR or antigen-binding fragment thereof or antibody or antigen-binding fragment thereof, is human. In some embodiments, the binding molecule is monoclonal. In some aspects, the binding molecule is a single chain. In other embodiments, the binding molecule contains two chains. In some embodiments, the binding molecule, e.g., TCR or antigen-binding fragment thereof or antibody or antigen-binding fragment thereof, is expressed on the surface of a cell.

In some aspects, the provided binding molecules have one or more specified functional features, such as binding properties, including binding to particular epitopes, and/or particular binding affinities as described.

A. T Cell Receptors (TCRs)

In some embodiments, the provided binding molecule is a T cell receptor (TCR) or antigen-binding fragment thereof. In some embodiments, a "T cell receptor" or "TCR" is a molecule that contains a variable α and β chains (also known as TCRα and TCRβ, respectively) or a variable γ and δ chains (also known as TCRγ and TCRδ, respectively), or antigen-binding portions thereof, and which is capable of specifically binding to an antigen, e.g., a peptide antigen or peptide epitope bound to an MHC molecule. In some embodiments, the TCR is in the αβ form. Typically, TCRs that exist in αβ and γδ forms are generally structurally similar, but T cells expressing them may have distinct anatomical locations or functions. A TCR can be found on the surface of a cell or in soluble form. Generally, a TCR is found on the surface of T cells (or T lymphocytes) where it is generally responsible for recognizing antigens, such as peptides bound to major histocompatibility complex (MHC) molecules.

Unless otherwise stated, the term "TCR" should be understood to encompass full TCRs as well as antigen-binding portions or antigen-binding fragments thereof. In some embodiments, the TCR is an intact or full-length TCR, such as a TCR containing the α chain and β chain. In some embodiments, the TCR is an antigen-binding portion that is less than a full-length TCR but that binds to a specific peptide bound in an MHC molecule, such as binds to an MHC-peptide complex. In some cases, an antigen-binding portion or fragment of a TCR can contain only a portion of the structural domains of a full-length or intact TCR, but yet is able to bind the peptide epitope, such as MHC-peptide complex, to which the full TCR binds. In some cases, an antigen-binding portion contains the variable domains of a TCR, such as variable α ($V_\alpha$) chain and variable β ($V_\beta$) chain of a TCR, or antigen-binding fragments thereof sufficient to form a binding site for binding to a specific MHC-peptide complex.

In some embodiments, the variable domains of the TCR contain complementarity determining regions (CDRs), which generally are the primary contributors to antigen recognition and binding capabilities and specificity of the peptide, MHC and/or MHC-peptide complex. In some embodiments, a CDR of a TCR or combination thereof forms all or substantially all of the antigen-binding site of a given TCR molecule. The various CDRs within a variable region of a TCR chain generally are separated by framework regions (FRs), which generally display less variability among TCR molecules as compared to the CDRs (see, e.g., Jores et al., *Proc. Nat'l Acad. Sci. U.S.A.* 87:9138, 1990; Chothia et al., *EMBO J.* 7:3745, 1988; see also Lefranc et al., *Dev. Comp. Immunol.* 27:55, 2003). In some embodiments, CDR3 is the main CDR responsible for antigen binding or specificity, or is the most important among the three CDRs on a given TCR variable region for antigen recognition, and/or for interaction with the processed peptide portion of the peptide-MHC complex. In some contexts, the CDR1 of the alpha chain can interact with the N-terminal part of certain antigenic peptides. In some contexts, CDR1 of the beta chain can interact with the C-terminal part of the peptide. In some contexts, CDR2 contributes most strongly to or is the primary CDR responsible for the interaction with or recognition of the MHC portion of the MHC-peptide complex. In some embodiments, the variable region of the β-chain can contain a further hypervariable region (CDR4 or HVR4), which generally is involved in superantigen binding and not antigen recognition (Kotb (1995) Clinical Microbiology Reviews, 8:411-426).

In some embodiments, the α-chain and/or α-chain of a TCR also can contain a constant domain, a transmembrane domain and/or a short cytoplasmic tail (see, e.g., Janeway et al., *Immunobiology: The Immune System in Health and Disease*, 3rd Ed., Current Biology Publications, p. 4:33, 1997). In some aspects, each chain (e.g. alpha or beta) of the TCR can possess one N-terminal immunoglobulin variable domain, one immunoglobulin constant domain, a transmembrane region, and a short cytoplasmic tail at the C-terminal end. In some embodiments, a TCR, for example via the cytoplasmic tail, is associated with invariant proteins of the CD3 complex involved in mediating signal transduction. In some cases, the structure allows the TCR to associate with other molecules like CD3 and subunits thereof. For example, a TCR containing constant domains with a transmembrane region may anchor the protein in the cell membrane and associate with invariant subunits of the CD3 signaling apparatus or complex. The intracellular tails of CD3 signaling subunits (e.g. CD3γ, CD3δ, CD3ε and CD3ζ chains) contain one or more immunoreceptor tyrosine-based activation motif or ITAM and generally are involved in the signaling capacity of the TCR complex.

It is within the level of a skilled artisan to determine or identify the various domains or regions of a TCR. In some cases, the exact locus of a domain or region can vary depending on the particular structural or homology modeling or other features used to describe a particular domain. It is understood that reference to amino acids, including to a specific sequence set forth as a SEQ ID NO used to describe domain organization of a TCR are for illustrative purposes and are not meant to limit the scope of the embodiments provided. In some cases, the specific domain (e.g. variable or constant) can be several amino acids (such as one, two, three or four) longer or shorter. In some aspects, residues of a TCR are known or can be identified according to the International Immunogenetics Information System (IMGT) numbering system (see e.g. www.imgt.org; see also, Lefranc et al. (2003) Developmental and Comparative Immunology, 27(1); 55-77; and The T Cell Factsbook 2nd Edition, Lefranc and LeFranc Academic Press 2001). Using this system, the CDR1 sequences within a TCR Vα chains and/or Vβ chain correspond to the amino acids present between residue numbers 27-38, inclusive, the CDR2 sequences within a TCR Vα chain and/or Vβ chain correspond to the amino acids present between residue numbers 56-65, inclusive, and the CDR3 sequences within a TCR Vα chain and/or Vβ chain correspond to the amino acids present between residue numbers 105-117, inclusive.

In some embodiments, the α chain and β chain of a TCR each further contain a constant domain. In some embodiments, the α chain constant domain (Cα) and β chain constant domain (Cβ) individually are mammalian, such as is a human or murine constant domain. In some embodiments, the constant domain is adjacent to the cell membrane. For example, in some cases, the extracellular portion of the TCR formed by the two chains contains two membrane-proximal constant domains, and two membrane-distal variable domains, which variable domains each contain CDRs.

In some aspects, provided herein are TCRs that contains a human constant region, such as an alpha chain containing a human Cα region and a beta chain containing a human Cβ. In some embodiments, the provided TCRs are fully human. Among the provided TCRs are TCRs containing a human constant region, such as fully human TCRs, whose expression and/or activity, such as when expressed in human cells, e.g. human T cells, such as primary human T cells, are not impacted by or are not substantially impacted by the presence of an endogenous human TCR. In particular, it is observed herein that certain TCRs, such as the exemplary TCR designated TCR 57; or a TCR containing Vα set forth in SEQ ID NO:47 and the Vβ set forth in SEQ ID NO: 60; or a TCR containing a CDRs set forth in SEQ ID NOS: 48, 49, 50, 61, 62 and 63, when formatted with a human constant region exhibit substantial activity in primary human T cells containing an endogenous TCR. In some embodiments, such TCRs containing a human constant region are not outcompeted by the endogenous human TCR, such as for components of the CD3 complex.

In some embodiments, such TCRs containing a human constant region are expressed at similar or improved levels on the cell surface, exhibit the similar or greater functional activity (e.g. cytolytic activity) and/or exhibit similar or greater anti-tumor activity, when expressed by human cells that contain or express an endogenous human TCR, such as human T cells, as compared to the level of expression, function activity and/or anti-tumor activity of the same TCR in similar human cells but in which expression of the endogenous TCR has been reduced or eliminated. In some examples a TCR containing a human constant region provided herein, when expressed in human T cells, is expressed on the cell surface at a level that is at least or at least about 80%, 85%, 90%, 95%, 100%, 105%, 110%, 115% or 120% of the level of expression of the same TCR when expressed in similar human T cells but in which expression of the endogenous TCR has been reduced or eliminated. In some examples a TCR containing a human constant region provided herein, when expressed in human T cells, exhibits an antigen-dependent functional activity, such as cytolytic activity, that is at least or at least about 80%, 85%, 90%, 95%, 100%, 105%, 110%, 115% or 120% of the activity as the same TCR expressed in similar human cells but in which expression of the endogenous TCR has been reduced or eliminated. In some examples a TCR containing a human constant region provided herein, when expressed in human T cells, exhibits anti-tumor activity, such as when administered in vivo to a subject, that is at least or at least about 80%, 85%, 90%, 95%, 100%, 105%, 110%, 115% or 120% of the anti-tumor activity of the same TCR when expressed in similar human cells but in which expression of the endogenous TCR has been reduced or eliminated. In some of any of the above embodiments, a cell in which expression of the endogenous TCR has been reduced or eliminated can include cells in which the genes and/or gene products encoding the TCR, such as TRAC and/or TRBC, is reduced, deleted, eliminated, knocked-out or disrupted, such as by any of a variety of gene editing methods.

In some embodiments, such TCRs containing a human constant region are expressed at similar or improved levels on the cell surface, exhibit the similar or greater functional activity (e.g. cytolytic activity) and/or exhibit similar or greater anti-tumor activity, when expressed by human cells that contain or express an endogenous human TCR, such as human T cells, as compared to the level of expression, functional activity and/or anti-tumor activity of a similar TCR containing the same Vβ and Vα regions but that is formatted with a mouse constant region when expressed in the human cells. In some examples a TCR containing a human constant region provided herein, when expressed in human T cells, is expressed on the cell surface at a level that is at least or at least about 80%, 85%, 90%, 95%, 100%, 105%, 110%, 115% or 120% of the level of expression of a similar TCR containing the same Vβ and Vα regions but that is formatted with a mouse constant region when expressed in the human T cells. In some examples a TCR containing a human constant region provided herein, when expressed in human T cells, exhibits an antigen-dependent functional activity, such as cytolytic activity, that is at least or at least about 80%, 85%, 90%, 95%, 100%, 105%, 110%, 115% or 120% of the activity of a similar TCR containing the same Vβ and Vα regions but that is formatted with a mouse constant region when expressed in the human T cells. In some examples a TCR containing a human constant region provided herein, when expressed in human T cells, exhibits anti-tumor activity, such as when administered in vivo to a subject, that is at least or at least about 80%, 85%, 90%, 95%, 100%, 105%, 110%, 115% or 120% of the anti-tumor activity of a similar TCR containing the same Vβ and Vα regions but that is formatted with a mouse constant region when expressed in the human T cells.

In some embodiments, each of the Cα and Cβ domains is human. In some embodiments, the Cα is encoded by the TRAC gene (IMGT nomenclature) or is a variant thereof. In some embodiments, the variant of a Cα contains replacement of at least one non-native cysteine, such as any replacement described herein. In some embodiments, the Cα or a variant thereof has or comprises the sequence of amino acids set forth in SEQ ID NO: 14, 333, 334, 335, 336, 337, 338, 341, 344, 345, 346, 347 or 348 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 14, 333, 334, 335, 336, 337, 338, 341, 344, 345, 346, 347 or 348. In some embodiments, the Cα has or comprises the sequence of amino acids set forth in SEQ ID NO: 14. In some embodiments, the Cβ is encoded by TRBC1 or TRBC2 genes (IMGT nomenclature) or is a variant thereof. In some embodiments, the variant of a Cβ contains replacement of at least one non-native cysteine, such as any replacement described herein. In some embodiments, the Cβ or variant thereof has or comprises the sequence of amino acids set forth in SEQ ID NO:29, 339, 340, 342, 343, 349, 350, 351 or 352 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 29, 339, 340, 342, 343, 349, 350, 351 or 352. In some embodiments, the Cβ has or comprises the sequence of amino acids set forth in SEQ ID NO: 29. In some embodiments, the Cβ has or comprises the sequence of amino acids set forth in SEQ ID NO: 350.

In some embodiments, the Cα is or comprises the sequence of amino acids set forth in SEQ ID NO: 14, 333, 334, 335, 336, 337, 338, 341, 344, 345, 346, 347 or 348 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 14, 333, 334, 335, 336, 337, 338, 341, 344, 345, 346, 347 or 348 and/or the Cβ is or comprises the sequence of amino acids set forth in SEQ ID NO: 29, 339, 340, 342, 343, 350, 351 or 352 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 29, 339, 340, 342, 343, 350, 351 or 352.

In some embodiments, any of the provided TCRs or antigen-binding fragments thereof can be a human/mouse chimeric TCR. In some cases, the TCR or antigen-binding fragment thereof comprises an alpha chain and/or a beta chain comprising a mouse constant region. In some embodiments, the Cα is a mouse constant region that is or comprises the sequence of amino acids set forth in SEQ ID NO: 15, or 275-282, or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 15, or 275-282. In some embodiments, the Cα is or comprises the sequence of amino acids set forth in SEQ ID NO: 15, or 275-282. In some embodiments, the Cβ is a mouse constant region that is or comprises the sequence of amino acids set forth in SEQ ID NO: 30 or 283-285 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 30 or 283-285. In some embodiments, the Cβ is or comprises the sequence of amino acids set forth in SEQ ID NO: 30 or 283-285.

In some embodiments, the Cα is or comprises the sequence of amino acids set forth in SEQ ID NO: 275, 276 or 279 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 275, 276 or 279 and/or the Cβ is or comprises the sequence of amino acids set forth in SEQ ID NO: 283 or 284 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 283 or 284. In some embodiments, the Cα and/or Cβ is or comprises any Cα and/or Cβ described in WO 2015/184228, WO 2015/009604 and WO 2015/009606.

In some embodiments, the TCR or antigen-binding fragment thereof comprises a variant of an alpha chain and/or a beta chain. In some embodiments, the variant comprises the amino acid sequence of any of the TCRs described herein with one, two, three, or four or more amino acid substitution(s) in the constant region of the alpha or beta chain. In some embodiments, the TCRs (or functional portions thereof) comprising the substituted amino acid sequence(s) advantageously provide one or more of decreased mis-pairing with an endogenous TCR chain(s), increased expression by a host cell, increased recognition of HPV 16 targets, and increased anti-tumor activity as compared to the parent TCR comprising an unsubstituted amino acid sequence.

In some embodiments, the constant region contains substituted amino acid sequences of the mouse constant regions of the TCR α and β chains corresponding with all or portions of the unsubstituted mouse constant region alpha amino acid sequences, e.g. SEQ ID NOs: 275, 276 or 279, and beta amino acid sequences, e.g. 282, 283 or 284, respectively. In some embodiments, the constant region is a substituted amino acid sequence of the mouse constant region TCR α and β chains set forth in SEQ ID NO: 280 and 285, respectively, with SEQ ID NO: 280 having one, two, three, or four amino acid substitution(s) when compared to SEQ ID NO: 279 and SEQ ID NO: 285 having one amino acid substitution when compared to SEQ ID NO: 284. In some embodiments, a variant of a TCR comprises the amino acid sequences of (a) SEQ ID NO: 280 (constant region of alpha chain), wherein (i) X at position 48 is Thr or Cys; (ii) X at position 112 is Ser, Gly, Ala, Val, Leu, Ile, Pro, Phe, Met, or Trp; (iii) X at position 114 is Met, Gly, Ala, Val, Leu, Ile, Pro, Phe, Met, or Trp; and (iv) X at position 115 is Gly, Ala, Val, Leu, Ile, Pro, Phe, Met, or Trp; and (b) SEQ ID NO: 285 (constant region of beta chain), wherein X at position 56 is Ser or Cys. In some embodiments, the Cα is or comprises the sequence of amino acids set forth in SEQ ID NO: 280 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 280 and/or the Cβ is or comprises the sequence of amino acids set forth in SEQ ID NO: 285 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 285.

In some embodiments, the TCR may be a heterodimer of two chains α and β that are linked, such as by a disulfide bond or disulfide bonds. In some embodiments, the constant domain of the TCR may contain short connecting sequences in which a cysteine residue forms a disulfide bond, thereby linking the two chains of the TCR. In some embodiments, a TCR may have an additional cysteine residue in each of the α and β chains, such that the TCR contains two disulfide bonds in the constant domains. In some embodiments, each of the constant and variable domains contains disulfide bonds formed by cysteine residues.

In some embodiments, the TCR can contain an introduced disulfide bond or bonds. In some embodiments, the native disulfide bonds are not present. In some embodiments, the one or more of the native cysteines (e.g. in the constant domain of the α chain and β chain) that form a native interchain disulfide bond are substituted to another residue, such as to a serine or alanine. In some embodiments, an introduced disulfide bond can be formed by mutating non-cysteine residues on the alpha and beta chains, such as in the constant domain of the α chain and β chain, to cysteine. Opposing cysteines in the TCR α and β chains provide a disulfide bond that links the constant regions of TCR α and β chains of the substituted TCR to one another and which is not present in a TCR comprising the unsubstituted constant region in which the native disulfide bonds are present, such as unsubstituted native human constant region or the unsubstituted native mouse constant region. In some embodiments, the presence of non-native cysteine residues (e.g. resulting in one or more non-native disulfide bonds) in a recombinant TCR can favor production of the desired recombinant TCR in a cell in which it is introduced over expression of a mismatched TCR pair containing a native TCR chain.

Exemplary non-native disulfide bonds of a TCR are described in published International PCT No. WO2006/000830 and WO2006/037960. In some embodiments, cysteines can be introduced or substituted at a residue corresponding to Thr48 of the Cα chain and Ser57 of the Cβ chain, at residue Thr45 of the Cα chain and Ser77 of the Cβ chain, at residue Tyr10 of the Cα chain and Ser17 of the Cβ chain, at residue Thr45 of the Cα chain and Asp59 of the Cβ chain and/or at residue Ser15 of the Cα chain and Glu15 of the Cβ chain with reference to numbering of a Cα set forth in any of SEQ ID NOS: 333-335, or 337, or Cβ set forth in SEQ ID NO: 339, or 340.

In some embodiments, any of the provided cysteine mutations can be made at a corresponding position in another sequence, for example, in a human or mouse Cα and Cβ sequence described above. The term "corresponding" with reference to positions of a protein, such as recitation that amino acid positions "correspond to" amino acid positions in a disclosed sequence, such as set forth in the Sequence listing, refers to amino acid positions identified upon alignment with the disclosed sequence based on structural sequence alignment or using a standard alignment algorithm, such as the GAP algorithm. For example, corresponding residues can be determined by alignment of a reference sequence with the Cα sequence set forth in any of SEQ ID NO: 333, 334, 335, 336 or 337, or the Cσ sequence set forth in SEQ ID NO: 339 or 340, by structural alignment methods as described herein. By aligning the sequences, one skilled in the art can identify corresponding residues, for example, using conserved and identical amino acid residues as guides. For example, Thr48 in the Cα chain aligns with or corresponds to Thr49 in the sequence set forth in SEQ ID NO: 338 or 341 and Ser57 in the Cβ chain aligns with or corresponds to Ser58 in the sequence set forth in SEQ ID NO:342 or 343.

In some embodiments, the constant region is cysteine-substituted compared to a native human constant region at positions corresponding to positions Thr48 and Ser57 as described above. In some embodiments, the variant of the TCR is a cysteine substituted in which one or both of the native Thr48 of SEQ ID NO:334 and the native Ser57 of SEQ ID NO:339 is substituted with Cys. In some embodiments, the Cα is or comprises the sequence of amino acids set forth in SEQ ID NO: 14 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 14 and/or the Cβ is or comprises the sequence of amino acids set forth in SEQ ID NO: 29 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 29. In some embodiments, the TCR comprises a Cα chain and a Cβ chain set forth in SEQ ID NO: 14 and 29, respectively. In some embodiments, the Cα is or comprises the sequence of amino acids set forth in SEQ ID NO: 14 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 14 and/or the Cβ is or comprises the sequence of amino acids set forth in SEQ ID NO: 350 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 350. In some embodiments, the TCR comprises a Cα chain and a Cβ chain set forth in SEQ ID NO: 14 and 350, respectively.

In some embodiments, the constant region is cysteine-substituted compared to a native mouse constant region at positions corresponding to positions Thr48 and Ser57 as described above. In some embodiments, the variant of the TCR is a cysteine-substituted, chimeric TCR in which one or both of the native Thr48 of SEQ ID NO: 279 and the native Ser57 of SEQ ID NO: 284 is substituted with Cys. In some embodiments, the Cα is or comprises the sequence of amino acids set forth in SEQ ID NO: 15 or 281 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 15 or 281 and/or the Cβ is or comprises the sequence of amino acids set forth in SEQ ID NO: 30 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 30. In some embodiments, the TCR comprises a Cα chain and a Cβ chain set forth in SEQ ID NO: 15 and 30, respectively. In some embodiments, the TCR comprises a Cα chain and a Cβ chain set forth in SEQ ID NO:281 and 30, respectively.

In some embodiments, the variant includes substitutions of one, two, or three amino acids in the transmembrane (TM) domain of the constant region of one or both of the α and β chains with a hydrophobic amino acid to provide a hydrophobic amino acid-substituted TCR. The hydrophobic amino acid substitution(s) in the TM domain of the TCR may increase the hydrophobicity of the TM domain of the TCR as compared to a TCR that lacks the hydrophobic amino acid substitution(s) in the TM domain. In some embodiments, the variant of the TCR comprises one, two, or three of the native Ser 112, Met 114, and Gly 115 of SEQ ID NO: 279 may, independently, be substituted with Gly, Ala, Val, Leu, Ile, Pro, Phe, Met, or Trp; for example with Leu, Ile, or Val. In some embodiments, the Cα is or comprises the sequence of amino acids set forth in SEQ ID NO: 282 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 282 and/or the Cβ is or comprises the sequence of amino acids set forth in SEQ ID NO: 284 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 284.

In some embodiments, the variant includes cysteine substitutions in the constant region of one or both of the α and β chains in combination with the substitution(s) of one, two, or three amino acids in the transmembrane (TM) domain of the constant region of one or both of the α and β chains with a hydrophobic amino acid. In some embodiments, the variant has the native Thr48 of SEQ ID NO: 279 substituted with Cys; one, two, or three of the native Ser 112, Met 114, and Gly 115 of SEQ ID NO: 279, independently, substituted with Gly, Ala, Val, Leu, Ile, Pro, Phe, Met, or Trp; for example with Leu, Ile, or Val; and the native Ser57 of SEQ ID NO: 284 substituted with Cys. In some embodiments, the Cα is or comprises the sequence of amino acids set forth in SEQ ID NO: 277 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 277 and/or the Cβ is or comprises the sequence of amino acids set forth in SEQ ID NO: 30 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 30.

Exemplary sequences (e.g. CDRs, Vα and/or Vβ and constant region sequences) of provided TCRs are described herein, e.g., in Section I.A. 1 below.

In some embodiments, the TCR is a full-length TCR. In some embodiments, the TCR is an antigen-binding portion. In some embodiments, the TCR is a dimeric TCR (dTCR). In some embodiments, the TCR is a single-chain TCR (sc-TCR). A TCR may be cell-bound or in soluble form. In some embodiments, the TCR is in cell-bound form expressed on the surface of a cell.

In some embodiments a dTCR contains a first polypeptide wherein a sequence corresponding to a provided TCR α chain variable region sequence is fused to the N terminus of a sequence corresponding to a TCR α chain constant region extracellular sequence, and a second polypeptide wherein a sequence corresponding to a provided TCR β chain variable region sequence is fused to the N terminus a sequence corresponding to a TCR β chain constant region extracellular sequence, the first and second polypeptides being linked by a disulfide bond. In some embodiments, the bond can correspond to the native interchain disulfide bond present in native dimeric αβ TCRs. In some embodiments, the interchain disulfide bonds are not present in a native TCR. For example, in some embodiments, one or more cysteines can be incorporated into the constant region extracellular sequences of dTCR polypeptide pair. In some cases, both a native and a non-native disulfide bond may be desirable. In some embodiments, the TCR contains a transmembrane sequence to anchor to the membrane.

In some embodiments, a dTCR contains a provided TCR α chain containing a variable α domain, a constant α domain and a first dimerization motif attached to the C-terminus of the constant α domain, and a provided TCR β chain comprising a variable β domain, a constant β domain and a first dimerization motif attached to the C-terminus of the constant β domain, wherein the first and second dimerization motifs easily interact to form a covalent bond between an amino acid in the first dimerization motif and an amino acid in the second dimerization motif linking the TCR α chain and TCR β chain together.

In some embodiments, the TCR is a scTCR, which is a single amino acid strand containing an α chain and a β chain that is able to bind to MHC-peptide complexes. Typically, a scTCR can be generated using methods known to those of skill in the art, See e.g., International published PCT Nos. WO 96/13593, WO 96/18105, WO99/18129, WO 04/033685, WO2006/037960, WO2011/044186; U.S. Pat. No. 7,569,664; and Schlueter, C. J. et al. J. Mol. Biol. 256, 859 (1996).

In some embodiments, a scTCR contains a first segment constituted by an amino acid sequence corresponding to a sequence of a provided TCR α chain variable region, a second segment constituted by an amino acid sequence corresponding to a provided TCR β chain variable region sequence fused to the N terminus of an amino acid sequence corresponding to a TCR β chain constant domain extracellular sequence, and a linker sequence linking the C terminus of the first segment to the N terminus of the second segment.

In some embodiments, a scTCR contains a first segment constituted by an amino acid sequence corresponding to a provided TCR β chain variable region, a second segment constituted by an amino acid sequence corresponding to a provided TCR α chain variable region sequence fused to the N terminus of an amino acid sequence corresponding to a TCR α chain constant domain extracellular sequence, and a linker sequence linking the C terminus of the first segment to the N terminus of the second segment.

In some embodiments, a scTCR contains a first segment constituted by a provided α chain variable region sequence fused to the N terminus of an α chain extracellular constant domain sequence, and a second segment constituted by a provided β chain variable region sequence fused to the N terminus of a sequence β chain extracellular constant and transmembrane sequence, and, optionally, a linker sequence linking the C terminus of the first segment to the N terminus of the second segment.

In some embodiments, a scTCR contains a first segment constituted by a provided TCR β chain variable region sequence fused to the N terminus of a β chain extracellular constant domain sequence, and a second segment constituted by a provided α chain variable region sequence fused to the N terminus of a sequence α chain extracellular constant and transmembrane sequence, and, optionally, a linker sequence linking the C terminus of the first segment to the N terminus of the second segment.

In some embodiments, for the scTCR to bind an MHC-peptide complex, the α and β chains must be paired so that the variable region sequences thereof are orientated for such binding. Various methods of promoting pairing of an α and β in a scTCR are well known in the art. In some embodiments, a linker sequence is included that links the α and β chains to form the single polypeptide strand. In some embodiments, the linker should have sufficient length to span the distance between the C terminus of the α chain and the N terminus of the β chain, or vice versa, while also ensuring that the linker length is not so long so that it blocks or reduces bonding of the scTCR to the target peptide-MHC complex.

In some embodiments, the linker of a scTCRs that links the first and second TCR segments can be any linker capable of forming a single polypeptide strand, while retaining TCR binding specificity. In some embodiments, the linker sequence may, for example, have the formula -P-AA-P-, wherein P is proline and AA represents an amino acid sequence wherein the amino acids are glycine and serine. In some embodiments, the first and second segments are paired so that the variable region sequences thereof are orientated for such binding. Hence, in some cases, the linker has a sufficient length to span the distance between the C terminus of the first segment and the N terminus of the second segment, or vice versa, but is not too long to block or reduces bonding of the scTCR to the target ligand. In some embodiments, the linker can contain from or from about 10 to 45 amino acids, such as 10 to 30 amino acids or 26 to 41 amino acids residues, for example 29, 30, 31 or 32 amino acids. In some embodiments, the linker has the formula -PGGG-(SGGGG)$_n$-P-, wherein n is 5 or 6 and P is proline, G is glycine and S is serine (SEQ ID NO: 287). In some embodiments, the linker has the sequence GSADDAKK-DAAKKDGKS (SEQ ID NO: 288).

In some embodiments, a scTCR contains a disulfide bond between residues of the single amino acid strand, which, in some cases, can promote stability of the pairing between the α and 1 regions of the single chain molecule (see e.g. U.S. Pat. No. 7,569,664). In some embodiments, the scTCR contains a covalent disulfide bond linking a residue of the immunoglobulin region of the constant domain of the α chain to a residue of the immunoglobulin region of the constant domain of the β chain of the single chain molecule. In some embodiments, the disulfide bond corresponds to the native disulfide bond present in a native dTCR. In some embodiments, the disulfide bond in a native TCR is not present. In some embodiments, the disulfide bond is an introduced non-native disulfide bond, for example, by incorporating one or more cysteines into the constant region extracellular sequences of the first and second chain regions of the scTCR polypeptide. Exemplary cysteine mutations include any as described above. In some cases, both a native and a non-native disulfide bond may be present.

In some embodiments, a scTCR is a non-disulfide linked truncated TCR in which heterologous leucine zippers fused to the C-termini thereof facilitate chain association (see e.g. International published PCT No. WO99/60120). In some embodiments, a scTCR contain a TCRα variable domain covalently linked to a TCRβ variable domain via a peptide linker (see e.g., International published PCT No. WO99/18129).

In some embodiments, any of the provided TCRs, including a dTCR or scTCR, can be linked to signaling domains that yield an active TCR on the surface of a T cell. In some embodiments, the TCR is expressed on the surface of cells. In some embodiments, the TCR does contain a sequence corresponding to a transmembrane sequence. In some embodiments, the transmembrane domain is positively charged. In some embodiments, the transmembrane domain can be a Cα or Cβ transmembrane domain. In some embodiments, the transmembrane domain can be from a non-TCR origin, for example, a transmembrane region from CD3z, CD28 or B7.1. In some embodiments, the TCR does contain a sequence corresponding to cytoplasmic sequences. In some embodiments, the TCR contains a CD3z signaling domain. In some embodiments, the TCR is capable of forming a TCR complex with CD3.

In some embodiments, the TCR is a soluble TCR. In some embodiments, the soluble TCR has a structure as described in WO99/60120 or WO 03/020763. In some embodiments, the TCR does not contain a sequence corresponding to the transmembrane sequence, for example, to permit membrane anchoring into the cell in which it is expressed. In some embodiments, the TCR does not contain a sequence corresponding to cytoplasmic sequences.

1. Exemplary TCRs

Provided herein are TCRs or antigen-binding fragments thereof that recognize or bind an epitope or region of a cancer antigen, such as a peptide epitope expressed on the surface of a cancer cell and/or a cell infected with HPV or a cell that contains HPV DNA sequences, in the context of an MHC molecule. In some embodiments, the TCR or antigen-binding fragment thereof binds to or recognizes an antigen expressed on the surface of the cell line designated SCC152 (ATCC® CRL-3240™), which is a cell line derived from a squamous cell carcinoma and that contains HPV DNA sequences. In some aspects, cytotoxic activity of T cells containing the binding molecules, e.g., TCRs, is stimulated upon contact of such cells with target cells, expressing the antigen, such as cancer cells and/or those that express HPV 16, such as HPV 16 E6 or HPV 16 E7, e.g. SCC152 cells. In some embodiments, among the provided TCRs or antigen-binding fragment thereof provided herein are those that bind or recognize a peptide epitope of HPV 16 in the context of an MHC (e.g. a peptide epitope of HPV 16 E6 or a peptide epitope of HPV 16 E7).

Among such TCRs or antigen-binding fragments thereof are TCRs or antigen-binding fragments thereof that contain any of the alpha and/or beta chain variable (Vα or Vβ) region sequences as described, individually, or a sufficient antigen-binding portion of such chain(s). In some embodiments, the provided TCR or antigen-binding fragment thereof (e.g. anti-HPV 16 E6 or anti-HPV 16 E7 TCRs) contains a Vα region sequence or sufficient antigen-binding portion thereof that contains a CDR-1, CDR-2 and/or CDR-3 as described. In some embodiments, the provided TCR or antigen-binding fragment thereof (e.g., anti-HPV 16 E6 or anti-HPV 16 E7 TCRs) contains a Vβ region sequence or sufficient antigen-binding portion that contains a CDR-1, CDR-2 and/or CDR-3 as described. In some embodiments, the TCR or antigen-binding fragment thereof (e.g. anti-HPV 16 E6 or anti-HPV 16 E7 TCRs) contains a Vα region sequence that contains a CDR-1, CDR-2 and/or CDR-3 as described and contains a Vβ region sequence that contains a CDR-1, CDR-2 and/or CDR-3 as described. Also among the provided TCRs are those having sequences at least at or about 90, 91, 92, 93, 94, 95, 96, 97, 98, or 99% identical to such a sequence.

In some embodiments, the TCR contains a Vα region that contains a complementarity determining region 3 (CDR-3) comprising the amino acid sequence $X_1X_2X_3X_4X_5X_6X_7X_8X_9X_{10}X_{11}X_{12}X_{13}$ (SEQ ID NO: 292), where $X_1$=A or G; $X_2$=A, G, P, V, or L; $X_3$=A, K, N, Y, D, or S; $X_4$=R, M, I, T, or G; $X_5$=N, E, L, D, V, or null; $X_6$=Y, G, N, D, or null; $X_7$=S, N, G, or null; $X_8$=G, N, Y, or null; $X_9$=D, F, G, N, or null; $X_{10}$=A, N, Q, or Y; $X_{11}$=K, R, or N; $X_{12}$=F, L, or Y; $X_{13}$=I, M, S, T, V, or Y. In some embodiments, the TCR contains a Vα region that contains a complementarity determining region 3 (CDR-3) comprising the amino acid sequence $X_1X_2X_3X_4X_5X_6X_7X_8X_9X_{10}X_{11}X_{12}X_{13}$ (SEQ ID NO: 356), where $X_1$=A or G; $X_2$=A, G, P, V, or L; $X_3$=A, K, N, Y, D, or S; $X_4$=R, M, I, T, or G; $X_5$=N, E, L, V, or null; $X_6$=Y, G, N, D, or null; $X_7$=S, N, G, or null; $X_8$=G, N, Y, or null; $X_9$=D, F, G, N, or null; $X_{10}$=A, N, Q, or Y; $X_{11}$=K, R, or N; $X_{12}$=F, L, or Y; $X_{13}$=I, M, S, T, V, or Y. In some embodiments, the TCR contains a Vα region that contains a complementarity determining region 3 (CDR-3) comprising the amino acid sequence AVNX$_4$X$_5$X$_6$X$_7$X$_8$NX$_{10}$X$_{11}$LX$_{13}$ (SEQ ID NO: 293), where $X_4$=M or I; $X_5$=E or L; $X_6$=G or N; $X_7$=S, G, or null; $X_8$=S or N; $X_{10}$=Y or A; $X_{11}$=K or R; $X_{13}$=T or M.

In some embodiments, the TCR or antigen-binding fragment thereof contains a Vα region containing a complementarity determining region 3 (CDR-3) comprising an amino acid sequence set forth in any of SEQ ID NOs: 12, 50, 80, 106, 129, 150, 172, 198, 224, or 250, or a sequence having at least at or about 90, 91, 92, 93, 94, 95, 96, 97, 98, or 99% identity with such a sequence. In some aspects, the TCR or antigen-binding fragment thereof contains a V, region containing a CDR3 contained within the amino acid sequence set forth in any of SEQ ID NOs: 9, 47, 77, 103, 126, 149, 169, 195, 221, or 247, or a sequence at least at or about 90, 91, 92, 93, 94, 95, 96, 97, 98, or 99% identical with such a sequence.

In some embodiments, the TCR contains a Vβ region that contains a complementarity determining region 3 (CDR-3) comprising the amino acid sequence $X_1X_2X_3X_4X_5X_6X_7X_8X_9X_{10}X_{11}X_{12}X_{13}$ (SEQ ID NO: 289), where $X_1$=A or S; $X_2$=A, I, S, or Y; $X_3$=S, T, or R; $X_4$=G, K, R, L, P, S, or Q; $X_5$=D, G, R, T, or W; $X_6$=A, E, F, R, S, Q, T or V; $X_7$=A, R, G, Y, or null; $X_8$=G, N, S, or null; $X_9$=A, D, G, S, or Y; $X_{10}$=L, N, or Y; $X_{11}$=E or V; $X_{12}$=L or Q; $X_{13}$=F, Y, or T. In some embodiments, the TCR contains a Vβ region that contains a complementarity determining region 3 (CDR-3) comprising the amino acid sequence $X_1X_2X_3X_4X_5X_6X_7X_8X_9X_{10}X_{11}X_{12}X_{13}$ (SEQ ID NO: 357), where $X_1$=A or S; $X_2$=A, I, S, or Y; $X_3$=S, T, or R; $X_4$=G, K, R, L, P, S, or Q; $X_5$=D, G, T, or W; $X_6$=A, E, F, R, S, Q, T or V; $X_7$=A, R, G, Y, or null; $X_8$=G, N, S, or null; $X_9$=A, D, G, S, or Y; $X_{10}$=L, N, or Y; $X_{11}$=E or V; $X_{12}$=L or Q; $X_{13}$=F, Y, or T. In some embodiments, the TCR contains a Vβ region that contains a complementarity determining region 3 (CDR-3) comprising the amino acid sequence $X_1X_2X_3X_4X_5X_6X_7X_8X_9X_{10}$EQF (SEQ ID NO: 290), where $X_1$=A or S; $X_2$=A or S; $X_3$=S or R; $X_4$=S, L, or P; $X_5$=W, D, or R; $X_6$=R, T, or Q; $X_7$=R, G, Y, or null; $X_8$=G, N, or S; $X_9$=G, D, or Y; $X_{10}$=N or L. In some embodiments, the TCR contains a Vβ region that contains a complementarity determining region 3 (CDR-3) comprising the amino acid sequence $X_1X_2X_3X_4X_5X_6X_7X_8X_9X_{10}$EQY (SEQ ID NO: 291), where $X_1$=A or S; $X_2$=I, S, or Y; $X_3$=S or T; $X_4$=G, P, R, or T; $X_5$=R or T; $X_6$=F, S, A, or V; $X_7$=S or T.

In some instances, the TCR contains a Vβ region containing a complementarity determining region 3 (CDR-3) comprising an amino acid sequence set forth in any of SEQ ID NOs:27, 63, 91, 115, 138, 158, 183, 209, 235, or 261, or a sequence having at least at or about 90, 91, 92, 93, 94, 95, 96, 97, 98, or 99% identity with such a sequence. In some embodiments, the TCR contains a Vβ region containing a CDR3 contained within the amino acid sequence set forth in any of SEQ ID NOs: 24, 60, 88, 114, 137, 157, 180, 206, 232, or 258 or a sequence at least at or about 90, 91, 92, 93, 94, 95, 96, 97, 98, or 99% identical with such a sequence.

In some embodiments, the Vα region contains a complementarity determining region 1 (CDR-1) comprising an amino acid sequence set forth in any of SEQ ID NOs: 10, 48, 78, 104, 127, 170, 196, 222, or 248, or a sequence having at least at or about 90, 91, 92, 93, 94, 95, 96, 97, 98, or 99% identity with such a sequence. In some aspects, the Vα region contains a CDR-1 contained within the amino acid sequence set forth in any of SEQ ID NOs: 9, 47, 77, 103, 126, 149, 169, 195, 221, or 247, or a sequence having at least at or about 90, 91, 92, 93, 94, 95, 96, 97, 98, or 99% identity with such a sequence. In some embodiments, the Vα region contains a complementarity determining region 2 (CDR-2) comprising an amino acid sequence set forth in any of SEQ ID NOs: 11, 49, 79, 105, 128, 171, 197, 223, or 249, or a sequence having at least at or about 90, 91, 92, 93, 94, 95, 96, 97, 98, or 99% identity with such a sequence. In some embodiments, the Vα region contains a CDR-2 contained within the amino acid sequence set forth in any of SEQ ID NOs: 9, 47, 77, 103, 126, 149, 169, 195, 221, or 247, or a sequence having at least at or about 90, 91, 92, 93, 94, 95, 96, 97, 98, or 99% identity with such a sequence.

In some instances, the Vβ region contains a complementarity determining region 1 (CDR-1) comprising an amino acid sequence set forth in any of SEQ ID NOs: 25, 61, 89, 181, 207, 233, or 259, or a sequence having at least at or about 90, 91, 92, 93, 94, 95, 96, 97, 98, or 99% identity with such a sequence. In some aspects, the Vβ region contains a CDR-1 contained within the amino acid sequence set forth in any of SEQ ID NOs: 24, 60, 88, 114, 137, 157, 180, 206, 232, or 258, or a sequence having at least at or about 90, 91, 92, 93, 94, 95, 96, 97, 98, or 99% identity with such a sequence. In some embodiments, the Vβ region contains a complementarity determining region 2 (CDR-2) comprising an amino acid sequence set forth in any of SEQ ID NOs: 26, 62, 90, 182, 208, 234, or 260, or a sequence having at least at or about 90, 91, 92, 93, 94, 95, 96, 97, 98, or 99% identity with such a sequence. In some embodiments, the Vβ region contains a CDR-2 contained within the amino acid sequence set forth in any of SEQ ID NOs: 24, 60, 88, 114, 137, 157, 180, 206, 232, or 258, or a sequence having at least at or about 90, 91, 92, 93, 94, 95, 96, 97, 98, or 99% identity with such a sequence.

In some embodiments, the Vα region contains the amino acid sequence set forth in any of SEQ ID NOs: 9, 47, 77, 103, 126, 149, 169, 195, 221, or 247, or an amino acid sequence that has at least 90%, 91%, 92%, 93%, 94%, 95%, 96%, 97%, 98%, or 99% sequence identity thereto. In some instances, the Vβ region contains the amino acid sequence set forth in any of SEQ ID NOs: 24, 60, 88, 114, 137, 157, 180, 206, 232, or 258, or an amino acid sequence that has at least 90%, 91%, 92%, 93%, 94%, 95%, 96%, 97%, 98%, or 99% sequence identity thereto. In some embodiments, the TCR contains an alpha chain comprising any of such Vα chain sequences and any of such Vβ chain sequences.

In some embodiments, the alpha chain of the TCR or antigen-binding fragment thereof further contains an alpha constant (Cα) region or portion thereof. In some aspects, the beta chain further contains a beta constant (Cβ) region or portion thereof. Thus, in some embodiments, the TCR, e.g., the HPV 16 E6 or E7 TCR or antigen-binding fragment thereof, contains an alpha chain comprising a variable alpha (Vα) region and an alpha constant (Cα) region or portion thereof and/or a beta chain comprising a variable beta (Vβ) region and a beta constant region (Cβ) or portion thereof.

In some cases, the Cα and Cβ regions are mouse constant regions, such as a native or variant (e.g. cysteine-substituted) mouse constant region, including any as described above. In some embodiments, the Cα region contains the amino acid sequence set forth in SEQ ID NO: 15, 275, 276, 277, 278, 279, 281 or 282 or a sequence of amino acids that has at least 90% sequence identity thereto, such as a sequence having at least at or about 90, 91, 92, 93, 94, 95, 96, 97, 98, or 99% identity with such a sequence. In some cases, the Cβ region contains the amino acid sequence set forth in SEQ ID NO: 30, 283, 284 or 285 or a sequence of amino acids that has at least 90% sequence identity thereto, such as a sequence having at least at or about 90, 91, 92, 93, 94, 95, 96, 97, 98, or 99% identity with such a sequence. In some embodiments, the Cα region contains the amino acid sequence set forth in SEQ ID NO: 15. In some embodiments, the Cβ region contains the amino acid sequence set forth in SEQ ID NO: 30.

In some embodiments, the Cα and Cβ regions are human constant regions, such as a native or variant (e.g. cysteine-substituted) human constant region, including any as described above. In some such embodiments, the Cα region comprises the amino acid sequence set forth in any of SEQ ID NOs: 14, 333, 334, 335, 336, 337, 338, 341, 344, 345, 346, 347 or 348, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region contains the amino acid sequence set forth in SEQ ID NO: 29, 339, 340, 342, 343, 349, 350, 351 or 352, or a sequence of amino acids that has at least 90% sequence identity thereto, such as a sequence having at least at or about 90, 91, 92, 93, 94, 95, 96, 97, 98, or 99% identity with such a sequence. In some embodiments, the Cα region contains the amino acid sequence set forth in SEQ ID NO: 14. In some embodiments, the Cβ has or comprises the sequence of amino acids set forth in SEQ ID NO: 350. In some embodiments, the Cβ region contains the amino acid sequence set forth in SEQ ID NO: 29.

Among such Cα and/or Cβ regions are those that are modified, for example, by incorporation of one or more non-native cysteine residues. In some embodiments, the modification corresponds to introduction of cysteine at residue Thr48 of the Cα chain and/or Ser57 of the Cβ chain, at residue Thr45 of the Cα chain and/or Ser77 of the Cβ chain, at residue Tyr10 of the Cα chain and/or Ser17 of the Cβ chain, at residue Thr45 of the Cα chain and Asp59 of the Cβ chain and/or at residue Ser15 of the Cα chain and Glu15 of the Cβ chain with reference to numbering of a Cα set forth in any of SEQ ID NOS: 333-335 or 337 or Cβ set forth in SEQ ID NO: 339 or 340.

In some such embodiments, the Cα region contains a non-native cysteine at a position corresponding to residue 48 and comprises the amino acid sequence set forth in any of SEQ ID NO: 14, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue or residues. In some aspects, the Cβ region contains a non-native cysteine at a position corresponding to residue 57 and contains the amino acid sequence set forth in SEQ ID NO: 29, or a sequence of amino acids that has at least 90% sequence identity thereto, such as a sequence having at least at or about 90, 91, 92, 93, 94, 95, 96, 97, 98, or 99% identity with such a sequence and that contains the non-native cysteine residue or residues. In some aspects, the Cβ region contains a non-native cysteine at a position corresponding to residue 57 and contains the amino acid sequence set forth in SEQ ID NO: 350, or a sequence of amino acids that has at least 90% sequence identity thereto, such as a sequence having at least at or about 90, 91, 92, 93, 94, 95, 96, 97, 98, or 99% identity with such a sequence and that contains the non-native cysteine residue or residues.

In some embodiments, the TCR or antigen-binding fragment thereof comprises an alpha chain that is or comprises the sequence of amino acids set forth in SEQ ID NO: 5, 43, 73, 99, 122, 145, 165, 191, 217, or 243 or a sequence of amino acids that has at least 90% sequence identity thereto, such as a sequence having at least at or about 90, 91, 92, 93, 94, 95, 96, 97, 98, or 99% identity with such a sequence and/or a beta chain that is or comprises the sequence of amino acids set forth in SEQ ID NO: 20, 56, 84, 110, 133, 153, 176, 202, 228, or 254 or a sequence of amino acids that has at least 90% sequence identity thereto, such as a sequence having at least at or about 90, 91, 92, 93, 94, 95, 96, 97, 98, or 99% identity with such a sequence. In some embodiments, the TCR or antigen-binding fragment thereof comprises an alpha chain that is or comprises the sequence of amino acids set forth in SEQ ID NO: 5, 43, 73, 99, 122, 145, 165, 191, 217, or 243 or a sequence of amino acids that has at least 90% sequence identity thereto, such as a sequence having at least at or about 90, 91, 92, 93, 94, 95, 96, 97, 98, or 99% identity with such a sequence and/or a beta chain that is or comprises the sequence of amino acids set forth in SEQ ID NO: 369, 359, 370, 371, 372, 373, 374, 375, 376 or 377 or a sequence of amino acids that has at least 90% sequence identity thereto, such as a sequence having at least at or about 90, 91, 92, 93, 94, 95, 96, 97, 98, or 99% identity with such a sequence.

In some such embodiments, the Cα region contains a non-native cysteine at a position corresponding to residue 48 and comprises the amino acid sequence set forth in any of SEQ ID NO: 15, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue or residues. In some aspects, the Cβ region contains a non-native cysteine at a position corresponding to residue 57 and contains the amino acid sequence set forth in SEQ ID NO: 30, or a sequence of amino acids that has at least 90% sequence identity thereto, such as a sequence having at least at or about 90, 91, 92, 93, 94, 95, 96, 97, 98, or 99% identity with such a sequence and that contains the non-native cysteine residue or residues.

In some embodiments, the TCR or antigen-binding fragment thereof comprises an alpha chain that is or comprises the sequence of amino acids set forth in SEQ ID NO: 6, 44, 74, 100, 123, 146, 166, 192, 218 or 244 or a sequence of amino acids that has at least 90% sequence identity thereto, such as a sequence having at least at or about 90, 91, 92, 93, 94, 95, 96, 97, 98, or 99% identity with such a sequence and/or a beta chain that is or comprises the sequence of amino acids set forth in SEQ ID NO: 21, 57, 85, 111, 134, 154, 177, 203, 229 or 255 or a sequence of amino acids that has at least 90% sequence identity thereto, such as a sequence having at least at or about 90, 91, 92, 93, 94, 95, 96, 97, 98, or 99% identity with such a sequence.

In some embodiments, the alpha chain and/or beta chain of the TCR is encoded by a sequence of nucleotides comprising a signal peptide (also called a leader sequence). Non-limiting examples of such a signal peptide are signal peptides that have or comprise the sequence of amino acids set forth in any of SEQ ID NOS: 13, 28, 51, 64, 81, 92, 107, 130, 173, 199, 225, 251, 184, 210, 236, 262, 286, 294, 327-332, 349 and 353-355.

In some embodiments, the TCR or antigen-binding fragment thereof has an alpha chain that is or comprises the sequence of amino acids set forth in SEQ ID NO: 7, 45, 75, 101, 124, 147, 167, 193, 219 or 245 or a sequence of amino acids that has at least 90% sequence identity thereto, such as a sequence having at least at or about 90, 91, 92, 93, 94, 95, 96, 97, 98, or 99% identity with such a sequence and/or a beta chain that is or comprises the sequence of amino acids set forth in SEQ ID NO: 22, 58, 86, 112, 135, 155, 178, 204, 230 or 256 or a sequence of amino acids that has at least 90% sequence identity thereto, such as a sequence having at least at or about 90, 91, 92, 93, 94, 95, 96, 97, 98, or 99% identity with such a sequence. In some embodiments, the TCR or antigen-binding fragment thereof is encoded by a sequence of nucleotides that encodes: a) an alpha chain that is or comprises the sequence of amino acids set forth in SEQ ID NO: 7, 45, 75, 101, 124, 147, 167, 193, 219 or 245, or a sequence of amino acids that has at least 90% sequence identity thereto, such as a sequence having at least at or about 90, 91, 92, 93, 94, 95, 96, 97, 98, or 99% identity with such a sequence and/or b) a beta chain that is or comprises the sequence of amino acids set forth in SEQ ID NO: 22, 58, 86, 112, 135, 155, 178, 204, 230 or 256, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof has an alpha chain that is or comprises the sequence of amino acids set forth in SEQ ID NO: 7, 45, 75, 101, 124, 147, 167, 193, 219 or 245 or a sequence of amino acids that has at least 90% sequence identity thereto, such as a sequence having at least at or about 90, 91, 92, 93, 94, 95, 96, 97, 98, or 99% identity with such a sequence and/or a beta chain that is or comprises the sequence of amino acids set forth in SEQ ID NO: 378, 360, 379, 380, 381, 382, 383, 384, 385 or 386, or a sequence of amino acids that has at least 90% sequence identity thereto, such as a sequence having at least at or about 90, 91, 92, 93, 94, 95, 96, 97, 98, or 99% identity with such a sequence. In some embodiments, the TCR or antigen-binding fragment thereof is encoded by a sequence of nucleotides that encodes: a) an alpha chain that is or comprises the sequence of amino acids set forth in SEQ ID NO: 7, 45, 75, 101, 124, 147, 167, 193, 219 or 245, or a sequence of amino acids that has at least 90% sequence identity thereto, such as a sequence having at least at or about 90, 91, 92, 93, 94, 95, 96, 97, 98, or 99% identity with such a sequence and/or b) a beta chain that is or comprises the sequence of amino acids set forth in SEQ ID NO: 378, 360, 379, 380, 381, 382, 383, 384, 385 or 386, or a sequence of amino acids that has at least 90% sequence identity thereto, such as a sequence having at least at or about 90, 91, 92, 93, 94, 95, 96, 97, 98, or 99% identity with such a sequence.

In some embodiments, the nucleic acid encoding the alpha chain and the nucleic acid encoding the beta chain can be connected via a linker, such as any described elsewhere herein.

In some embodiments, the TCR or antigen-binding fragment thereof has an alpha chain that is or comprises the sequence of amino acids set forth in SEQ ID NO: 8, 46, 76, 102, 125, 148, 168, 194, 220 or 246 or a sequence of amino acids that has at least 90% sequence identity thereto, such as a sequence having at least at or about 90, 91, 92, 93, 94, 95, 96, 97, 98, or 99% identity with such a sequence and/or a beta chain that is or comprises the sequence of amino acids set forth in SEQ ID NO: 23, 59, 87, 113, 136, 156, 179, 205, 231 or 257 or a sequence of amino acids that has at least 90% sequence identity thereto, such as a sequence having at least at or about 90, 91, 92, 93, 94, 95, 96, 97, 98, or 99% identity with such a sequence. In some embodiments, the TCR or antigen-binding fragment thereof is encoded by a sequence of nucleotides that encodes: a) an alpha chain that is or comprises the sequence of amino acids set forth in SEQ ID NO: 8, 46, 76, 102, 125, 148, 168, 194, 220 or 246, or a sequence of amino acids that has at least 90% sequence identity thereto, such as a sequence having at least at or about 90, 91, 92, 93, 94, 95, 96, 97, 98, or 99% identity with such a sequence and/or b) a beta chain that is or comprises the sequence of amino acids set forth in SEQ ID NO: 23, 59, 87, 113, 136, 156, 179, 205, 231 or 257, or a sequence of amino acids that has at least 90% sequence identity thereto, such as a sequence having at least at or about 90, 91, 92, 93, 94, 95, 96, 97, 98, or 99% identity with such a sequence. In some embodiments, the nucleic acid encoding the alpha chain and the nucleic acid encoding the beta chain can be connected via a linker, such as any described elsewhere herein.

In some embodiments, among the TCR or antigen-binding fragments thereof provided herein are those that bind to or recognize an antigen expressed on the surface of a cancer cell and/or a cell that is infected with HPV or that contains HPV DNA sequences. In some aspects, such binding or recognition is with respect to the cell line designated SCC152. In some aspects, engineered T cells containing or expressing such a TCR or antigen-binding fragment thereof exhibits cytotoxic activity upon contact with a cancer target cell and/or a target cell infected with HPV or that contains HPV DNA sequences, e.g. SCC152 cell.

Exemplary of such TCRs or antigen-binding fragments are those set forth in Tables 2A and 2B, such as in each row therein. In some embodiments, the Vα and Vβ regions contain the amino acid sequences corresponding to the SEQ ID NOs: set forth in Table 2A or 2B, such as in each row therein. In some embodiments, the Vα and Vβ regions contain the CDR-1, the CDR-2 and the CDR-3 sequences contained within the Vα and Vβ regions set forth in Table 2A or 2B, such as in each row therein. In some aspects, the TCR contains constant alpha and constant beta region sequences, such as those corresponding to the SEQ ID NOs: set forth in Table 2A or 2B, such as in each row therein. In some cases, the TCR contains a full sequence comprising the variable and constant chain, such as a sequence corresponding to the SEQ ID NOs: set forth in Table 2A or 2B ("Full"), such as in each row therein. In some embodiments, the full sequence containing the variable and constant regions also includes a signal sequence and thus comprises a sequence corresponding to the SEQ ID NOS: set forth in Table 2A or 2B ("Full+signal"), such as in each row therein. Also among the provided TCRs are those containing sequences at least at or about 90, 91, 92, 93, 94, 95, 96, 97, 98, or 99% identical to such sequences. Exemplary TCRs containing such sequences, or their modified versions as described elsewhere herein, also are set forth in the Tables 2A and 2B, respectively, such as in each row therein.

YMLDLQPET (SEQ ID NO. 271). Exemplary of such TCRs are described below.

a. HPV 16 E6(29-38)

Provided herein are anti-HPV 16 E6 (29-38) TCRs or antigen-binding fragments thereof. In some cases, the TCR recognizes or binds a peptide epitope derived from HPV16 E6 that is or contains E6(29-38) TIHDIILECV (SEQ ID NO: 268). In some embodiments, the TCR recognizes or binds HPV 16 E6 (29-38) in the context of an MHC, such as an MHC class I, e.g. HLA-A2. In some embodiments, the provided TCRs or antigen-binding fragments thereof are capable of or bind to a HPV 16 E6(29-38)-peptide-MHC tetramer complex.

In some embodiments, the Vα region contains a complementarity determining region 3 (CDR-3) comprising an amino acid sequence set forth in SEQ ID NO: 250 or a sequence having at least at or about 90, 91, 92, 93, 94, 95, 96, 97, 98, or 99% identity with such a sequence. In some embodiments, the Vα region further contains a complementarity determining region 1 (CDR-1) comprising an amino acid sequence set forth in SEQ ID NO: 248 or a sequence having at least at or about 90, 91, 92, 93, 94, 95, 96, 97, 98, or 99% identity with such a sequence. In some embodiments, the Vα region further contains a complementarity determining region 2 (CDR-2) comprising an amino acid sequence set forth in SEQ ID NO: 249 or a sequence having

TABLE 2A

Cancer antigen (e.g. SCC152) TCR SEQ ID NOs with Human Constant.

| Exemplary TCR | Alpha | | | | Beta | | | |
|---|---|---|---|---|---|---|---|---|
| | Variable (Vα) | Human Constant | Full | Full + signal | Variable (Vβ) | Human Constant | Full | Full + signal |
| TCR 56 | 9 | 14 | 5 | 7 | 24 | 29 | 20 | 22 |
| TCR 57 | 47 | 14 | 43 | 45 | 60 | 29 | 56 | 58 |
| TCR 63 | 195 | 14 | 191 | 193 | 206 | 29 | 202 | 204 |
| TCR 64 | 221 | 14 | 217 | 219 | 232 | 29 | 228 | 230 |
| TCR 56 | 9 | 14 | 5 | 7 | 24 | 350 | 369 | 378 |
| TCR 57 | 47 | 14 | 43 | 45 | 60 | 350 | 359 | 360 |
| TCR 63 | 195 | 14 | 191 | 193 | 206 | 350 | 375 | 384 |
| TCR 64 | 221 | 14 | 217 | 219 | 232 | 350 | 376 | 385 |

TABLE 2B

Cancer antigen (e.g. SCC152) TCR SEQ ID NOs with Mouse Constants.

| Exemplary modified version of TCR | Alpha | | | | Beta | | | |
|---|---|---|---|---|---|---|---|---|
| | Variable (Vα) | Mouse Constant | Full | Full + signal | Variable Vβ | Mouse Constant | Full | Full + signal |
| TCR 56 | 9 | 15 | 6 | 8 | 24 | 30 | 21 | 23 |
| TCR 57 | 47 | 15 | 44 | 46 | 60 | 30 | 57 | 59 |
| TCR 63 | 195 | 15 | 192 | 194 | 206 | 30 | 203 | 205 |
| TCR 64 | 221 | 15 | 218 | 220 | 232 | 30 | 229 | 231 |

In some embodiments, among the TCR or antigen-binding fragments thereof provided herein are those that recognize or binds to an epitope or region of HPV16 E6, such as a peptide epitope E6(29-38) comprising the amino acid sequence TIHDIILECV (SEQ ID NO. 268). In some aspects, among the TCR or antigen-binding fragments thereof provided herein are those that recognize or bind to an epitope or region of HPV16 E7 protein, such as a peptide epitope E7(11-19) comprising the amino acid sequence at least at or about 90, 91, 92, 93, 94, 95, 96, 97, 98, or 99% identity with such a sequence. In some cases, the Vα region contains a CDR-1, CDR-2 and CDR-3 contained within the amino acid sequence set forth in SEQ ID NO: 247 or a sequence having at least at or about 90, 91, 92, 93, 94, 95, 96, 97, 98, or 99% identity with such a sequence.

In some embodiments, the Vβ region contains a complementarity determining region 3 (CDR-3) comprising an amino acid sequence set forth in SEQ ID NO: 261 or a sequence having at least at or about 90, 91, 92, 93, 94, 95, 96, 97, 98, or 99% identity with such a sequence. In some embodiments, the Vβ region further contains a complementarity determining region 1 (CDR-1) comprising an amino acid sequence set forth in SEQ ID NO: 259 or a sequence having at least at or about 90, 91, 92, 93, 94, 95, 96, 97, 98, or 99% identity with such a sequence. In some embodiments, the Vβ region further contains a complementarity determining region 2 (CDR-2) comprising an amino acid sequence set forth in SEQ ID NO: 260 or a sequence having at least at or about 90, 91, 92, 93, 94, 95, 96, 97, 98, or 99% identity with such a sequence. In some examples, the Vβ region contains a CDR-1, CDR-2 and CDR-3 contained within the amino acid sequence set forth in SEQ ID NO: 258 or a sequence having at least at or about 90, 91, 92, 93, 94, 95, 96, 97, 98, or 99% identity with such a sequence.

In some embodiments, the TCR or antigen-binding fragment thereof contains a Vα region that contains a complementarity determining region 1 (CDR-1) comprising an amino acid sequence set forth in SEQ ID NO: 248, a complementarity determining region 2 (CDR-2) comprising an amino acid sequence set forth in SEQ ID NO: 249, and/or a complementarity determining region 3 (CDR-3) comprising an amino acid sequence set forth in SEQ ID NO: 250. Also among the provided TCRs are those having sequences at least at or about 90, 91, 92, 93, 94, 95, 96, 97, 98, or 99% identical to such sequences. In some aspects, the TCR or antigen-binding fragment thereof contains a Vβ region that contains a complementarity determining region 1 (CDR-1) comprising an amino acid sequence set forth in SEQ ID NO: 259, a complementarity determining region 2 (CDR-2) comprising an amino acid sequence set forth in SEQ ID NO: 260 and/or a complementarity determining region 3 (CDR-3) comprising an amino acid sequence set forth in SEQ ID NO: 261. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, a CDR-2, and a CDR-3, comprising the amino acid sequences of SEQ ID NOs: 248, 249, and 250, respectively, and the Vβ region contains a CDR-1, a CDR-2, and a CDR-3, comprising the amino acid sequences of SEQ ID NOs: 259, 260, and 261, respectively. Also among the provided TCRs are those having sequences at least at or about 90, 91, 92, 93, 94, 95, 96, 97, 98, or 99% identical to such sequences.

In some embodiments, the TCR or antigen-binding fragment includes a Vα region that contains a complementarity determining region 1 (CDR-1), a CDR-2, and a CDR-3, respectively comprising the CDR-1, the CDR-2, and the CDR-3 amino acid sequences set forth in Table 3; and a Vβ region that contains a complementarity determining region 1 (CDR-1), a CDR-2, and a CDR-3, respectively comprising the CDR-1, the CDR-2, and the CDR-3 amino acid sequences set forth in Table 3. Also among the provided TCRs are those containing sequences at least at or about 90, 91, 92, 93, 94, 95, 96, 97, 98, or 99% identical to such sequences. Exemplary TCRs containing such CDRs, or their modified versions as described elsewhere herein, also are set forth in the Table 3.

TABLE 3

| HPV16 E6(29-38) TCR CDR SEQ ID NOs. | | | | | | |
|---|---|---|---|---|---|---|
| Exemplary | Alpha | | | Beta | | |
| TCR | CDR1 | CDR2 | CDR3 | CDR1 | CDR2 | CDR3 |
| TCR 65 | 248 | 249 | 250 | 259 | 260 | 261 |

In some instances, the TCR or antigen-binding fragment thereof contains Vα and Vβ regions containing the amino acid sequences of SEQ ID NOs: 247 and 258, respectively. Also among the provided TCRs are those containing sequences at least at or about 90, 91, 92, 93, 94, 95, 96, 97, 98, or 99% identical to such sequences.

In some embodiments, the alpha chain of the TCR or antigen-binding fragment thereof further contains a Cα region or portion thereof and/or the beta chain further contains a Cβ region or portion thereof. In some embodiments, the Cα region or portion thereof is or comprises a human Cα region, such as a native human Cα region or a variant thereof, for example set forth in any of SEQ ID NOs: 14, 333, 334, 335, 336, 337, 338, 341, 344, 345, 346, 347 or 348, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region or portion thereof is or comprises a human Cβ region, such as a native human Cβ region or a variant thereof, for example set forth in SEQ ID NO: 29, 339, 340, 342, 343, 349, 350, 351 or 352, or a sequence of amino acids that has at least 90% sequence identity thereto, such as a sequence having at least at or about 90, 91, 92, 93, 94, 95, 96, 97, 98, or 99% identity with such a sequence. In some embodiments, the Cα and/or Cβ regions are variants that are modified, for example, by incorporation of one or more non-native cysteine residues, such as any described herein. In some embodiments, the Cα region or portion thereof contains a non-native cysteine at residue 48 and comprises the amino acid sequence set forth in any of SEQ ID NO: 14, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue (e.g. Cys48). In some aspects, the Cβ region contains a non-native cysteine at residue 57 and contains the amino acid sequence set forth in SEQ ID NO: 29, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region contains a non-native cysteine at residue 57 and contains the amino acid sequence set forth in SEQ ID NO: 350, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 243 or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 254 or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 243 or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 377 or a sequence of amino acids that has at least 90% sequence identity thereto, such as a sequence having at least at or about 90, 91, 92, 93, 94, 95, 96, 97, 98, or 99% identity with such a sequence.

In some embodiments, the Cα region or portion thereof is or comprises a mouse Cα region, such as a native mouse Cα region or a variant thereof, for example set forth in any of SEQ ID NOs: 15, 275, 276, 277, 278, 279, 281 or 282, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region or portion thereof is or comprises a mouse Cβ region, such as a native mouse Cβ region or a variant thereof, for example set forth in SEQ ID NO: 30, 283, 284 or 285, or a sequence of amino acids that has at least 90% sequence identity thereto, such as a sequence having at least at or about 90, 91, 92, 93, 94, 95, 96, 97, 98, or 99% identity with such a sequence. In some embodiments, the Cα and/or Cβ regions are variants that are modified, for example, by incorporation of one or more non-native cysteine residues, such as any described herein. In some embodiments, the Cα region or portion thereof contains a non-native cysteine at residue 48 and comprises the amino acid sequence set forth in any of SEQ ID NO: 15, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue (e.g. Cys48). In some aspects, the Cβ region contains a non-native cysteine at residue 57 and contains the amino acid sequence set forth in SEQ ID NO: 30, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 244 or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 255 or a sequence of amino acids that has at least 90% sequence identity thereto, such as a sequence having at least at or about 90, 91, 92, 93, 94, 95, 96, 97, 98, or 99% identity with such a sequence.

Exemplary TCRs or antigen-binding fragments include those set forth in Tables 4A and 4B, such as in each row therein. In some embodiments, the Vα and Vβ regions contain the amino acid sequences corresponding to the SEQ ID NOs: set forth in Table 4A or 4B, such as in each row therein. In some embodiments, the Vα and Vβ regions contain the CDR-1, the CDR-2 and the CDR-3 sequences contained within the Vα and Vβ regions set forth in Table 4A or 4B, such as in each row therein. In some aspects, the TCR contains constant alpha and constant beta region sequences, such as those corresponding to the SEQ ID NOs: set forth in Table 4A or 4B, such as in each row therein. In some cases, the TCR contains a full sequence comprising the variable and constant chain, such as a sequence corresponding to the SEQ ID NOs: set forth in Table 4A or 4B ("Full"), such as in each row therein. In some embodiments, the full sequence containing the variable and constant regions also includes a signal sequence and thus comprises a sequence corresponding to the SEQ ID NOS: set forth in Table 4A or 4B ("Full+signal"), such as in each row therein. Also among the provided TCRs are those containing sequences at least at or about 90, 91, 92, 93, 94, 95, 96, 97, 98, or 99% identical to such sequences. Exemplary TCRs containing such sequences, or their modified versions as described elsewhere herein, also are set forth in the Tables 4A and 4B, respectively, such as in each row therein.

TABLE 4A

HPV16 E6(29-38) TCR SEQ ID NOs. with Human Constant

| Exemplary TCR | Alpha | | | | Beta | | | |
|---|---|---|---|---|---|---|---|---|
| | Variable (Vα) | Human Constant | Full | Full + signal | Variable (Vβ) | Human Constant | Full | Full + signal |
| TCR 65 | 247 | 14 | 243 | 245 | 258 | 29 | 254 | 256 |
| TCR 65 | 247 | 14 | 243 | 245 | 258 | 350 | 377 | 386 |

TABLE 4B

HPV16 E6(29-38) TCR SEQ ID NOs. with Mouse Constant

| Exemplary modified version of TCR | Alpha | | | | Beta | | | |
|---|---|---|---|---|---|---|---|---|
| | Variable (Vα) | Mouse Constant | Full | Full + signal | Variable (Vβ) | Mouse Constant | Full | Full + signal |
| TCR 65 | 247 | 15 | 244 | 246 | 258 | 30 | 255 | 257 | b. HPV 16 E7(11-19)

Provided herein are anti-HPV 16 E7 (11-19) TCRs or antigen-binding fragments thereof. In some cases, the TCR recognizes or binds a peptide epitope derived from HPV 16 E7 that is or contains E7(11-19) YMLDLQPET (SEQ ID NO: 271). In some embodiments, the TCR recognizes or binds HPV 16 E7(11-19) in the context of an MHC, such as an MHC class I, e.g., HLA-A2. In some embodiments, the provided TCRs or antigen-binding fragments thereof are capable of or bind to a HPV 16 E7 (11-19)-peptide-MHC tetramer complex. In some aspects, engineered T cells containing or expressing such a TCR or antigen-binding fragment thereof exhibits cytotoxic activity upon contact with a cancer target cell and/or a target cell infected with HPV or that contains HPV DNA sequences, e.g. SCC152 cell.

In some embodiments, the TCR or antigen-binding fragment thereof contains a Vα region containing a complementarity determining region 3 (CDR-3) comprising the amino acid sequence $X_1X_2X_3X_4X_5X_6X_7X_8X_9X_{10}X_{11}X_{12}X_{13}$ (SEQ ID NO: 292), where $X_1$=A or G; $X_2$=A, G, P, V, or L; $X_3$=A, K, N, Y, D, or S; $X_4$=R, M, I, T, or G; $X_5$=N, E, L, D, V, or null; $X_6$=Y, G, N, D, or null; $X_7$=S, N, G, or null; $X_8$=G, N, Y, or null; $X_9$=D, F, G, N, or null; $X_{10}$=A, N, Q, or Y; $X_{11}$=K, R, or N; $X_{12}$=F, L, or Y; and $X_{13}$=I, M, S, T, V, or Y. In some embodiments, the TCR contains a Vα region that contains a complementarity determining region 3 (CDR-3) comprising the amino acid sequence $X_1X_2X_3X_4X_5X_6X_7X_8X_9X_{10}X_{11}X_{12}X_{13}$ (SEQ ID NO: 356), where $X_1$=A or G; $X_2$=A, G, P, V, or L; $X_3$=A, K, N, Y, D, or S; $X_4$=R, M, I, T, or G; $X_5$=N, E, L, V, or null; $X_6$=Y, G, N, D, or null; $X_7$=S, N, G, or null; $X_8$=G, N, Y, or null; $X_9$=D, F, G, N, or null; $X_{10}$=A, N, Q, or Y; $X_{11}$=K, R, or N; $X_{12}$=F, L, or Y; $X_{13}$=I, M, S, T, V, or Y.

In some embodiments, the TCR or antigen-binding fragment thereof contains a Vα region containing a complementarity determining region 3 (CDR-3) comprising the amino acid sequence $AVNX_4X_5X_6X_7X_8X_9X_{10}X_{11}LX_{13}$ (SEQ ID NO:293), $X_4$=M or I; $X_5$=E or L; $X_6$=G or N; $X_7$=S, G, or null; $X_8$=S or N; $X_{10}$=Y or A; $X_{11}$=K or R, and $X_{13}$=T or M.

In some aspects, the TCR or antigen-binding fragment thereof contains a Vβ region containing a complementarity determining region 3 (CDR-3) comprising the amino acid sequence $X_1X_2X_3X_4X_5X_6X_7X_8X_9X_{10}X_{11}X_{12}X_{13}$ (SEQ ID NO: 289), where $X_1$=A or S; $X_2$=A, I, S, or Y; $X_3$=S, T, or R; $X_4$=G, K, R, L, P, S, or Q; $X_5$=D, G, R, T, or W; $X_6$=A, E, F, R, S, Q, T or V; $X_7$=A, R, G, Y, or null; $X_8$=G, N, S, or null; $X_9$=A, D, G, S, or Y; $X_{10}$=L, N, or Y; $X_{11}$=E or V; $X_{12}$=L or Q; $X_{13}$=F, Y, or T. In some embodiments, the TCR contains a Vβ region that contains a complementarity determining region 3 (CDR-3) comprising the amino acid sequence $X_1X_2X_3X_4X_5X_6X_7X_8X_9X_{10}X_{11}X_{12}X_{13}$ (SEQ ID NO: 357), where $X_1$=A or S; $X_2$=A, I, S, or Y; $X_3$=S, T, or R; $X_4$=G, K, R, L, P, S, or Q; $X_5$=D, G, T, or W; $X_6$=A, E, F, R, S, Q, T or V; $X_7$=A, R, G, Y, or null; $X_8$=G, N, S, or null; $X_9$=A, D, G, S, or Y; $X_{10}$=L, N, or Y; $X_{11}$=E or V; $X_{12}$=L or Q; $X_{13}$=F, Y, or T.

In some embodiments, the TCR or antigen-binding fragment thereof contains a Vβ region containing a complementarity determining region 3 (CDR-3) comprising the amino acid sequence $X_1X_2X_3X_4X_5X_6X_7X_8X_9X_{10}EQF$ (SEQ ID NO: 290), where $X_1$=A or S; $X_2$=A or S; $X_3$=S or R; $X_4$=S, L, or P; $X_5$=W, D, or R; $X_6$=R, T, or Q; $X_7$=R, G, Y, or null; $X_8$=G, N, or S; $X_9$=G, D, or Y; $X_{10}$=N or L.

In some embodiments, the TCR or antigen-binding fragment thereof contains a Vβ region containing a complementarity determining region 3 (CDR-3) comprising the amino acid sequence $X_1X_2X_3X_4X_5X_6X_7X_8X_9X_{10}QY$ (SEQ ID NO: 291), where $X_1$=A or S; $X_2$=I, S, or Y; $X_3$=S or T; $X_4$=G, P, R, or T; $X_5$=R or T; $X_6$=F, S, A, or V; $X_7$=S or T.

In some embodiments, the Vα region contains a complementarity determining region 3 (CDR-3) comprising the amino acid sequence set forth in any of SEQ ID NOs: 50, 80, 106, 129, 150, 172, 198 or 224, or a CDR3 contained within the amino acid sequence set forth in any of SEQ ID NOs: 47, 77, 103, 126, 149, 169, 195, or 221. In some embodiments, the Vα region contains a CDR3 sequence at least at or about 90, 91, 92, 93, 94, 95, 96, 97, 98, or 99% identical to such sequences.

In some embodiments, the Vα region further contains a complementarity determining region 1 (CDR-1) comprising an amino acid sequence set forth in any of SEQ ID NOs: 48, 78, 104, 127, 170, 196, or 222, or a CDR1 contained within the amino acid sequence set forth in any of SEQ ID NOs: 47, 77, 103, 126, 149, 169, 195, or 221. In some embodiments, the Vα region contains a CDR-1 sequence at least at or about 90, 91, 92, 93, 94, 95, 96, 97, 98, or 99% identical to such sequences. In some aspects, the Vα region further contains a complementarity determining region 2 (CDR-2) comprising an amino acid sequence set forth in any of SEQ ID NOs: 49, 79, 105, 128, 171, 197, or 223, or a CDR2 contained within the amino acid sequence set forth in any of SEQ ID NOs: 47, 77, 103, 126, 149, 169, 195, or 221. In some embodiments, the Vα region contains a CDR-1 sequence at least at or about 90, 91, 92, 93, 94, 95, 96, 97, 98, or 99% identical to such sequences.

In some aspects, the Vβ region contains a complementarity determining region 3 (CDR-3) comprising an amino acid sequence set forth in any of SEQ ID NOs: 27, 63, 91, 115, 138, 158, 183, 209, or 235 or a CDR3 contained within the amino acid sequence set forth in any of SEQ ID NOs: 60, 88, 114, 137, 157, 180, 206, or 232. In some embodiments, the Vβ region contains a CDR3 sequence at least at or about 90, 91, 92, 93, 94, 95, 96, 97, 98, or 99% identical to such sequences.

In some embodiments, the Vβ region contains a complementarity determining region 1 (CDR-1) comprising the amino acid sequence set forth in SEQ ID NO: 61, 89, 181, 207, or 233, or a CDR-1 contained within the amino acid sequence set forth in any of SEQ ID NOs: 60, 88, 114, 137, 157, 180, 206, or 232. In some embodiments, the Vβ region contains a CDR-1 sequence at least at or about 90, 91, 92, 93, 94, 95, 96, 97, 98, or 99% identical to such sequences. In some instances, the Vβ region contains a complementarity determining region 2 (CDR-2) comprising the amino acid sequence set forth in SEQ ID NO: 62, 90, 182, 208, or 234, or a CDR-2 contained within the amino acid sequence set forth in any of SEQ ID NOs: 60, 88, 114, 137, 157, 180, 206, or 232. In some embodiments, the Vβ region contains a CDR-2 sequence at least at or about 90, 91, 92, 93, 94, 95, 96, 97, 98, or 99% identical to such sequences.

In some embodiments, the TCR or antigen-binding fragment thereof contains a Vα region that contains a CDR-1, a CDR-2, and a CDR-3, comprising the amino acid sequences of SEQ ID NOs: 48, 49, and 50, respectively, and a Vβ region that contains a CDR-1, CDR-2, and CDR-3 comprising the amino acid sequences of SEQ ID NOs: 61, 62, and 63, respectively. Also among the provided TCRs are those having sequences at least at or about 90, 91, 92, 93, 94, 95, 96, 97, 98, or 99% identical to such sequences.

In some aspects, the TCR or antigen-binding fragment thereof contains a Vα region that contains a CDR-1, a CDR-2, and a CDR-3, comprising the amino acid sequences of SEQ ID NOs: 78, 79, and 80, respectively, and a Vβ region that contains a CDR-1, a CDR-2, and a CDR-3, comprising the amino acid sequences of SEQ ID NOs: 89, 90, and 91, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, a CDR-2, and a CDR-3, comprising the amino acid sequences of SEQ ID NOs: 104, 105, and 106, respectively, and a Vβ region that contains a CDR-1, a CDR-2, and a CDR-3, comprising the amino acid sequences of SEQ ID NOs: 89, 90, and 115, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, a CDR-2, and a CDR-3, comprising the amino acid sequences of SEQ ID NOs: 127, 128, and 129, respectively, and a Vβ region that contains a CDR-1, a CDR-2, and a CDR-3, comprising the amino acid sequences of SEQ ID NOs: 89, 90, and 138, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, a CDR-2, and a CDR-3, comprising the amino acid sequences of SEQ ID NOs: 127, 128, and 150, respectively, and a Vβ region that contains a CDR-1, a CDR-2, and a CDR-3, comprising the amino acid sequences of SEQ ID NOs: 89, 90, and 158, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, a CDR-2, and a CDR-3, comprising the amino acid sequences of SEQ ID NOs: 170, 171, and 172, respectively, and a Vβ region that contains a CDR-1, a CDR-2, and a CDR-3, comprising the amino acid sequences of SEQ ID NOs: 181, 182, and 183, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, a CDR-2, and a CDR-3, comprising the amino acid sequences of SEQ ID NOs: 196, 197, and 198, respectively, and a Vβ region that contains a CDR-1, a CDR-2, and a CDR-3, comprising the amino acid sequences of SEQ ID NOs: 207, 208, and 209, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, a CDR-2, and a CDR-3, comprising the amino acid sequences of SEQ ID NOs: 222, 223, and 224, respectively, and a Vβ region that contains a CDR-1, a CDR-2, and a CDR-3, comprising the amino acid sequences of SEQ ID NOs: 233, 234, and 235, respectively. Also among the provided TCRs are those having sequences at least at or about 90, 91, 92, 93, 94, 95, 96, 97, 98, or 99% identical to such sequences.

In some instances, the Vα region contains a complementarity determining region 1 (CDR-1), a CDR-2, and a CDR-3, respectively comprising the CDR-1, the CDR-2, and the CDR-3 amino acid sequences contained within a Vα region amino acid sequence set forth in any of SEQ ID NOs: 47, 77, 103, 126, 149, 169, 195, or 221. In some cases, the Vβ region contains a complementarity determining region 1 (CDR-1), a CDR-2, and a CDR-3, respectively comprising the CDR-1, the CDR-2, and the CDR-3 amino acid sequences contained within a Vβ region amino acid sequence set forth in any of SEQ ID NOs: 60, 88, 114, 137, 157, 180, 206, or 232. Also among the provided TCRs are those containing sequences at least at or about 90, 91, 92, 93, 94, 95, 96, 97, 98, or 99% identical to such sequences.

In some embodiments, the TCR or antigen-binding fragment includes a Vα region that contains a complementarity determining region 1 (CDR-1), a CDR-2, and a CDR-3, respectively comprising the CDR-1, the CDR-2, and the CDR-3 amino acid sequences set forth in Table 5 and a Vβ region that contains a complementarity determining region 1 (CDR-1), a CDR-2, and a CDR-3, respectively comprising the CDR-1, the CDR-2, and the CDR-3 amino acid sequences set forth in Table 5. Also among the provided TCRs are those containing sequences at least at or about 90, 91, 92, 93, 94, 95, 96, 97, 98, or 99% identical to such sequences. Exemplary TCRs containing such CDRs, or their modified versions as described elsewhere herein, also are set forth in the Table 5.

TABLE 5

| Exemplary | HPV16 E7(11-19) TCR CDR SEQ ID NOs. | | | | | |
|---|---|---|---|---|---|---|
| | Alpha | | | Beta | | |
| TCR | CDR1 | CDR2 | CDR3 | CDR1 | CDR2 | CDR3 |
| TCR 57 | 48 | 49 | 50 | 61 | 62 | 63 |
| TCR 58 | 78 | 79 | 80 | 89 | 90 | 91 |
| TCR 59 | 104 | 105 | 106 | 89 | 90 | 115 |
| TCR 60 | 127 | 128 | 129 | 89 | 90 | 138 |
| TCR 61 | 127 | 128 | 150 | 89 | 90 | 158 |
| TCR 62 | 170 | 171 | 172 | 181 | 182 | 183 |
| TCR 63 | 196 | 197 | 198 | 207 | 208 | 209 |
| TCR 64 | 222 | 223 | 224 | 233 | 234 | 235 |

In some embodiments, the TCR or antigen-binding fragment thereof contains Vα and Vβ regions containing the amino acid sequences of SEQ ID NOs: 47 and 60, respectively. In some aspects, the Vα and Vβ regions contain the amino acid sequences of SEQ ID NOs: 77 and 88, respectively. In some aspects, the Vα and Vβ regions contain the amino acid sequences of SEQ ID NOs: 103 and 114, respectively. In some cases, the Vα and Vβ regions contain the amino acid sequences of SEQ ID NOs: 126 and 137, respectively. In some instances, the Vα and Vβ regions contain the amino acid sequences of SEQ ID NOs: 149 and 157, respectively. In some aspects, the Vα and Vβ regions contain the amino acid sequences of SEQ ID NOs: 169 and 180, respectively. In some embodiments, the Vα and Vβ regions contain the amino acid sequences of SEQ ID NOs: 195 and 206, respectively. In some cases, the Vα and Vβ regions contain the amino acid sequences of SEQ ID NOs: 221 and 232, respectively. Also among the provided TCRs are those containing sequences at least at or about 90, 91, 92, 93, 94, 95, 96, 97, 98, or 99% identical to such sequences.

In some embodiments, the alpha chain of the TCR or antigen-binding fragment thereof further contains a Cα region or portion thereof and/or the beta chain further contains a Cβ region or portion thereof. In some embodiments, the Cα region or portion thereof is or comprises a human Cα region, such as a native human Cα region or a variant thereof, for example set forth in any of SEQ ID NO:14, 333, 334, 335, 336, 337, 338, 341, 344, 345, 346, 347 or 348, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region or a portion thereof is or comprises a human Cβ region, such as a native human Cβ region or a variant thereof, for example set forth in SEQ ID NO: 29, 339, 340, 342, 343, 349, 350, 351 or 352 or a sequence of amino acids that has at least 90% sequence identity thereto, such as a sequence having at least at or about 90, 91, 92, 93, 94, 95, 96, 97, 98, or 99% identity with such a sequence. In some embodiments, the Cα and/or Cβ regions are variants that are modified, for example, by incorporation of one or more non-native cysteine residues, such as any described herein. In some embodiments, the Cα region or portion thereof contains a non-native cysteine at residue 48 and comprises the amino acid sequence set forth in any of SEQ ID NOs: 14, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue (e.g., Cys48). In some aspects, the Cβ region contains a non-native cysteine at residue 57 and contains the amino acid sequence set forth in SEQ ID NO: 29, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region contains a non-native cysteine at residue 57 and contains the amino acid sequence set forth in SEQ ID NO: 350, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO:43, 73, 99, 122, 145, 165, 191, or 217, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 56, 84, 110, 133, 153, 176, 202, 228 or 359, or a sequence of amino acids that has at least 90% sequence identity thereto, such as a sequence having at least at or about 90, 91, 92, 93, 94, 95, 96, 97, 98, or 99% identity with such a sequence. In some embodiments, the TCR or antigen-binding fragment thereof comprises an alpha chain comprising the sequence of amino acids set forth in SEQ ID NO:43, 73, 99, 122, 145, 165, 191, or 217, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 359, 370, 371, 372, 373, 374, 375 or 376, or a sequence of amino acids that has at least 90% sequence identity thereto, such as a sequence having at least at or about 90, 91, 92, 93, 94, 95, 96, 97, 98, or 99% identity with such a sequence.

In some embodiments, the Cα region or portion thereof is or comprises a mouse Cα region, such as a native mouse Cα region or a variant thereof, for example set forth in any of SEQ ID NOs: 15, 275, 276, 277, 278, 279, 281 or 282, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region or portion thereof is or comprises a mouse Cβ region, such as a native mouse Cβ region or a variant thereof, for example set forth in SEQ ID NO: 30, 283, 284 or 285, or a sequence of amino acids that has at least 90% sequence identity thereto, such as a sequence having at least at or about 90, 91, 92, 93, 94, 95, 96, 97, 98, or 99% identity with such a sequence. In some embodiments, the Cα and/or Cβ regions are variants that are modified, for example, by incorporation of one or more non-native cysteine residues, such as any described herein. In some embodiments, the Cα region or portion thereof contains a non-native cysteine at residue 48 and comprises the amino acid sequence set forth in any of SEQ ID NO: 15, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue (e.g. Cys48). In some aspects, the Cβ region contains a non-native cysteine at residue 57 and contains the amino acid sequence set forth in SEQ ID NO: 30, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 46, 76, 102, 125, 148, 168, 194, or 220, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 57, 85, 111, 134, 154, 177, 203, or 229, or a sequence of amino acids that has at least 90% sequence identity thereto, such as a sequence having at least at or about 90, 91, 92, 93, 94, 95, 96, 97, 98, or 99% identity with such a sequence.

Exemplary TCRs or antigen-binding fragments include those set forth in Tables 6A and 6B, such as in each row therein. In some embodiments, the Vα and Vβ regions contain the amino acid sequences corresponding to the SEQ ID NOs: set forth in Table 6A or 6B, such as in each row therein. In some embodiments, the Vα and Vβ regions contain the CDR-1, the CDR-2 and the CDR-3 sequences contained within the Vα and Vβ regions set forth in Table 6A or 6B, such as in each row therein. In some aspects, the TCR contains constant alpha and constant beta region sequences, such as those corresponding to the SEQ ID NOs: set forth in Table 6A or 6B, such as in each row therein. In some cases, the TCR contains a full sequence comprising the variable and constant chain, such as a sequence corresponding to the SEQ ID NOs: set forth in Table 6A or 6B ("Full"), such as in each row therein. In some embodiments, the full sequence containing the variable and constant regions also includes a signal sequence and thus comprises a sequence corresponding to the SEQ ID NOS: set forth in Table 6A or 6B ("Full+signal"), such as in each row therein. Also among the provided TCRs are those containing sequences at least at or about 90, 91, 92, 93, 94, 95, 96, 97, 98, or 99% identical to such sequences. Exemplary TCRs containing such sequences, or their modified versions as described elsewhere herein, also are set forth in the Tables 6A and 6B, respectively, such as in each row therein.

TABLE 6A

HPV16 E7(11-19) TCR SEQ ID NOs with Human Constant.

| Exemplary TCR | Alpha | | | | Beta | | | |
|---|---|---|---|---|---|---|---|---|
| | Variable (Vα) | Human Constant | Full | Full + signal | Variable (Vβ) | Human Constant | Full | Full + signal |
| TCR 57 | 47 | 14 | 43 | 45 | 60 | 29 | 56 | 58 |
| TCR 58 | 77 | 14 | 73 | 75 | 88 | 29 | 84 | 86 |
| TCR 59 | 103 | 14 | 99 | 101 | 114 | 29 | 110 | 112 |
| TCR 60 | 126 | 14 | 122 | 124 | 137 | 29 | 133 | 135 |
| TCR 61 | 149 | 14 | 145 | 147 | 157 | 29 | 153 | 155 |
| TCR 62 | 169 | 14 | 165 | 167 | 180 | 29 | 176 | 178 |
| TCR 63 | 195 | 14 | 191 | 193 | 206 | 29 | 202 | 204 |
| TCR 64 | 221 | 14 | 217 | 219 | 232 | 29 | 228 | 230 |
| TCR 57 | 47 | 14 | 43 | 45 | 60 | 350 | 359 | 360 |
| TCR 58 | 77 | 14 | 73 | 75 | 88 | 350 | 370 | 379 |
| TCR 59 | 103 | 14 | 99 | 101 | 114 | 350 | 371 | 380 |
| TCR 60 | 126 | 14 | 122 | 124 | 137 | 350 | 372 | 381 |
| TCR 61 | 149 | 14 | 145 | 147 | 157 | 350 | 373 | 382 |
| TCR 62 | 169 | 14 | 165 | 167 | 180 | 350 | 374 | 383 |
| TCR 63 | 195 | 14 | 191 | 193 | 206 | 350 | 375 | 384 |
| TCR 64 | 221 | 14 | 217 | 219 | 232 | 350 | 376 | 385 |

TABLE 6B

HPV16 E7(11-19) TCR SEQ ID NOs with Mouse Constants.

| Exemplary modified version of TCR | Alpha | | | | Beta | | | |
|---|---|---|---|---|---|---|---|---|
| | Variable (Vα) | Mouse Constant | Full | Full + signal | Variable (Vβ) | Mouse Constant | Full | Full + signal |
| TCR 57 | 47 | 15 | 44 | 46 | 60 | 30 | 57 | 59 |
| TCR 58 | 77 | 15 | 74 | 76 | 88 | 30 | 85 | 87 |
| TCR 59 | 103 | 15 | 100 | 102 | 114 | 30 | 111 | 113 |
| TCR 60 | 126 | 15 | 123 | 125 | 137 | 30 | 134 | 136 |
| TCR 61 | 149 | 15 | 146 | 148 | 157 | 30 | 154 | 156 |
| TCR 62 | 169 | 15 | 166 | 168 | 180 | 30 | 177 | 179 |
| TCR 63 | 195 | 15 | 192 | 194 | 206 | 30 | 203 | 205 |
| TCR 64 | 221 | 15 | 218 | 220 | 232 | 30 | 229 | 231 |

Among the TCRs provided herein is a TCR containing a Vα having a CDR1, 2 and 3 set forth in SEQ ID NOS: 48, 49 and 50, respectively, and a Vβ having a CDR1, 2, and 3 set forth in SEQ ID NOS: 61, 62 and 63, respectively. In some embodiments, such a TCR contains a Vα set forth in SEQ ID NO: 47 and a Vβ set forth in SEQ ID NO: 60. In some embodiments, such a TCR contains an alpha chain further containing a Cα region and a beta chain further containing a Cβ region. In some embodiments, the Cα and Cβ are human constant regions or are functional variants thereof. In some embodiments, such as TCR contains an alpha chain containing a Cα human constant region or a variant thereof containing a non-native cysteine replacement, such as any described herein. In some embodiments, such a TCR contains an alpha chain containing a Cα constant region set forth in SEQ ID NO: 14. In some embodiments, such a TCR contains a beta chain containing a Cβ human constant region or a variant thereof containing a non-native cysteine replacement, such as any described herein. In some embodiments, such a TCR contains a beta chain containing a Cβ region set forth in SEQ ID NO:29 or SEQ ID NO:350. In some embodiments, such a TCR contains a Cα set forth in SEQ ID NO: 14 and a Cβ set forth in SEQ ID NO:29. In some embodiments, such as TCR contains a Cα set forth in SEQ ID NO:14 and a Cβ set forth in SEQ ID NO:350. In some embodiments, such a TCR contains an alpha chain set forth in SEQ ID NO:43 and a beta chain set forth in SEQ ID NO:56. In some embodiments, such a TCR contains an alpha chain set forth in SEQ ID NO:43 and a beta chain set forth in SEQ ID NO:359. In some embodiments, the TCR is encoded by a polynucleotide that encodes the sequence set forth in SEQ ID NO:69. In some embodiments, the TCR is encoded by a polynucleotide that encodes the sequence set forth in SEQ ID NO:362. Also among the provided TCRs are those containing sequences at least at or about 90, 91, 92, 93, 94, 95, 96, 97, 98, or 99% identical to such sequences, which, in some aspects, include a Vα having a CDR1, 2 and 3 set forth in SEQ ID NOS: 48, 49 and 50, respectively, and a Vβ having a CDR1, 2, and 3 set forth in SEQ ID NOS: 61, 62 and 63, respectively.

2. Variants & Modifications

In some embodiments, the binding molecule, e.g., TCR or antigen-binding fragment thereof, is or has been modified. In certain embodiments, the binding molecules, e.g., TCRs or antigen-binding fragments thereof, include one or more amino acid variations, e.g., substitutions, deletions, insertions, and/or mutations, compared to the sequence of a binding molecule, e.g., TCR, described herein. Exemplary variants include those designed to improve the binding affinity and/or other biological properties of the binding molecule. Amino acid sequence variants of a binding molecule may be prepared by introducing appropriate modifications into the nucleotide sequence encoding the binding molecule, or by peptide synthesis. Such modifications include, for example, deletions from, and/or insertions into and/or substitutions of residues within the amino acid sequences of the binding molecule. Any combination of deletion, insertion, and substitution can be made to arrive at the final construct, provided that the final construct possesses the desired characteristics, e.g., antigen-binding.

In some embodiments, directed evolution methods are used to generate TCRs with altered properties, such as with higher affinity for a specific peptide in the context of an MHC molecule. In some embodiments, directed evolution is achieved by display methods including, but not limited to, yeast display (Holler et al. (2003) Nat Immunol, 4, 55-62; Holler et al. (2000) Proc Natl Acad Sci USA, 97, 5387-92), phage display (Li et al. (2005) Nat Biotechnol, 23, 349-54), or T cell display (Chervin et al. (2008) J Immunol Methods, 339, 175-84). In some embodiments, display approaches involve engineering, or modifying, a known, parent or reference TCR. For example, in some cases, a reference TCR, such as any provided herein, can be used as a template for producing mutagenized TCRs in which in one or more residues of the CDRs are mutated, and mutants with an desired altered property, such as higher affinity for peptide epitope in the context of an MHC molecule, are selected.

In certain embodiments, the binding molecules, e.g., TCRs or antigen-binding fragments thereof, include one or more amino acid substitutions, e.g., as compared to a binding molecule, e.g., TCR, sequence described herein and/or compared to a sequence of a natural repertoire, e.g., human repertoire. Sites of interest for substitutional mutagenesis include the CDRs, FRs and/or constant regions. Amino acid substitutions may be introduced into a binding molecule of interest and the products screened for a desired activity, e.g., retained/improved antigen affinity or avidity, decreased immunogenicity, improved half-life, CD8-independent binding or activity, surface expression, promotion of TCR chain pairing and/or other improved properties or functions.

In some embodiments, one or more residues within a CDR of a parent binding molecule, e.g., TCR, is/are substituted. In some embodiments, the substitution is made to revert a sequence or position in the sequence to a germline sequence, such as a binding molecule sequence found in the germline (e.g., human germline), for example, to reduce the likelihood of immunogenicity, e.g., upon administration to a human subject.

In certain embodiments, substitutions, insertions, or deletions may occur within one or more CDRs so long as such alterations do not substantially reduce the ability of the binding molecule, e.g., TCR or antigen-binding fragment thereof, to bind antigen. For example, conservative alterations (e.g., conservative substitutions as provided herein) that do not substantially reduce binding affinity may be made in CDRs. Such alterations may, for example, be outside of antigen contacting residues in the CDRs. In certain embodiments of the variable sequences provided herein, each CDR either is unaltered, or contains no more than one, two or three amino acid substitutions.

Amino acid sequence insertions include amino- and/or carboxyl-terminal fusions ranging in length from one residue to polypeptides containing a hundred or more residues, as well as intrasequence insertions of single or multiple amino acid residues.

In some aspects, the TCR or antigen-binding fragment thereof may contain one or more modifications in the alpha chain and/or beta chain such that when the TCR or antigen-binding fragment thereof is expressed in a cell, the frequency of mis-pairing between the TCR alpha chain and beta chain and an endogenous TCR alpha chain and beta chain is reduced, the expression of the TCR alpha chain and beta chain is increased, and/or the stability of the TCR alpha chain and beta chain is increased.

In some embodiments, the TCR contains one or more non-native cysteine residues to introduce a covalent disulfide bond linking a residue of the immunoglobulin region of the constant domain of the α chain to a residue of the immunoglobulin region of the constant domain of the β chain. In some embodiments, one or more cysteines can be incorporated into the constant region extracellular sequences of the first and second segments of the TCR polypeptide. Exemplary non-limiting modifications in a TCR to introduce a non-native cysteine residues are described herein (see also, International PCT No. WO2006/000830 and WO2006037960). In some cases, both a native and a non-native disulfide bond may be desirable. In some embodiments, the TCR or antigen-binding fragment is modified such that the interchain disulfide bond in a native TCR is not present.

In some embodiments, the transmembrane domain of the constant region of the TCR can be modified to contain a greater number of hydrophobic residues (see e.g. Haga-Friedman et al. (2012) Journal of Immunology, 188:5538-5546). In some embodiments, the transmembrane region of TCR α chain contains one or more mutations corresponding to S116L, G119V or F120L, with reference to numbering of a Cα set forth in any of SEQ ID NOS: 212, 213, 215, 217, 220, or 524.

In some embodiments, the cell expressing the TCR further includes a surrogate marker, such as a cell surface marker, which may be used to confirm transduction or engineering of the cell to express the TCR, such as a truncated version of a cell surface receptor. In some aspects, the marker includes all or part (e.g., truncated form) of CD34, a NGFR, Her2 or epidermal growth factor receptor (e.g., tEGFR). In some embodiments, the nucleic acid encoding the marker is operably linked to a polynucleotide encoding for a linker sequence, such as a cleavable linker sequence, e.g., T2A. See WO2014031687. In some embodiments, introduction of a construct encoding the TCR and surrogate marker separated by a T2A, P2A or other ribosome switch can express two proteins from the same construct, such that the surrogate marker can be used as a marker to detect cells expressing such construct. Exemplary of such markers that can be used are described below.

In some embodiments, the TCR or antigen-binding fragment thereof is encoded by a nucleotide sequence that is or has been codon-optimized and/or modified to eliminate cryptic splice sites. Exemplary codon-optimized variants are described elsewhere herein.

B. Antibodies

In some embodiments, the binding molecule is an antibody or antigen-binding fragment thereof that contains any one or more of the CDRs as described above with respect to TCRs.

In some embodiments, the antibody or antigen-binding fragment contains variable heavy and light chain containing a CDR1, a CDR2 and/or a CDR3 contained in the alpha chain and a CDR1, a CDR2 and/or a CDR3 contained in the beta chain as set forth in Table 3 or Table 5. Also among the provided antibodies or antigen-binding fragments are those containing sequences at least at or about 90, 91, 92, 93, 94, 95, 96, 97, 98, or 99% identical to such sequences.

In some embodiments, the antibody or antigen-binding fragment contains a variable region that contains a complementarity determining region 1 (CDR-1), a CDR-2, and a CDR-3, respectively comprising the CDR-1, the CDR-2, and the CDR-3 amino acid sequences contained within a Vα region amino acid sequence set forth in SEQ ID NO: 247. In some aspects, the antibody or antigen-binding fragment contains a variable region that contains a complementarity determining region 1 (CDR-1), a CDR-2, and a CDR-3, respectively comprising the CDR-1, the CDR-2, and the CDR-3 amino acid sequences contained within a Vβ region amino acid sequence set forth in SEQ ID NO:258. Also among the provided antibodies or antigen-bind fragments are those containing sequences at least at or about 90, 91, 92, 93, 94, 95, 96, 97, 98, or 99% identical to such sequences.

In some embodiments, the provided antibody or antibody fragment is a human antibody. In some embodiments, the provided antibody or antibody fragment contains a $V_H$ region that contains a portion having at least 95%, 96%, 97%, 98%, 99%, or 100% sequence identity to an amino acid sequence encoded by a germline nucleotide human heavy chain V segment, a portion with at least 95%, 96%, 97%, 98%, 99%, or 100% identity to an amino acid sequence encoded by a germline nucleotide human heavy chain D segment, and/or a portion having at least 95%, 96%, 97%, 98%, 99%, or 100% identity to an amino acid sequence encoded by a germline nucleotide human heavy chain J segment; and/or contains a $V_L$ region that contains a portion with at least 95%, 96%, 97%, 98%, 99%, or 100% identity to an amino acid sequence encoded by a germline nucleotide human kappa or lambda chain V segment, and/or a portion with at least 95%, 96%, 97%, 98%, 99%, or 100% identity to an amino acid sequence encoded by a germline nucleotide human kappa or lambda chain J segment. In some embodiments, the portion of the $V_H$ region corresponds to the CDR-H1, CDR-H2 and/or CDR-H3. In some embodiments, the portion of the $V_H$ region corresponds to the framework region 1 (FR1), FR2, FR2 and/or FR4. In some embodiments, the portion of the $V_L$ region corresponds to the CDR-L1, CDR-L2 and/or CDR-L3. In some embodiments, the portion of the $V_L$ region corresponds to the FR1, FR2, FR2 and/or FR4.

In some embodiments, the antibody or antigen-binding fragment contains a framework region that contains human germline gene segment sequences. For example, in some embodiments, the antibody or antigen-binding fragment contains a $V_H$ region in which the framework region, e.g. FR1, FR2, FR3 and FR4, has at least 95%, 96%, 97%, 98%, 99%, or 100% sequence identity to a framework region encoded by a human germline antibody segment, such as a V and/or J segment. In some embodiments, the human antibody contains a $V_L$ region in which the framework region e.g. FR1, FR2, FR3 and FR4, has at least 95%, 96%, 97%, 98%, 99%, or 100% sequence identity to a framework region encoded by a human germline antibody segment, such as a V and/or segment. For example, in some such embodiments, the framework sequence of the $V_H$ and/or $V_L$ sequence differs by no more than 10 amino acids, such as no more than 9, 8, 7, 6, 5, 4, 3, 2 or 1 amino acid, compared to the framework region encoded by a human germline antibody segment. In some embodiments, the antibodies and antigen binding fragments thereof, e.g. TCR-like antibodies, specifically recognize a peptide epitope in the context of an MHC molecule, such as an MHC class I. In some cases, the MHC class I molecule is an HLA-A2 molecule, e.g. HLA-A2*01.

In some embodiments, the antibody or antigen-binding fragment thereof recognizes or binds to an epitope or region of HPV16 E6, such as a peptide epitope containing an amino acid sequence set forth in any of SEQ ID NOs: 267-269. In some instances, the TCR or antigen-binding fragment thereof that recognizes or binds a peptide epitope derived from HPV 16 E6 is or comprises the sequence set forth in SEQ ID NO: 268.

In some aspects, the TCR or antigen-binding fragment recognizes or binds to an epitope or region of HPV16 E7 protein, such as a peptide epitope containing an amino acid sequence set forth in any of SEQ ID NOs: 270-274. In some embodiments, the TCR or antigen-binding fragment thereof does not recognize or bind the epitope E7 (11-19) comprising the amino acid sequence YMLDLQPET (SEQ ID NO: 271). In some cases, the peptide derived from HPV16 E7 is or contains the sequence set forth in SEQ ID NO: 270.

Thus, provided in some embodiments are anti-HPV antibodies, including functional antibody fragments. In some embodiments, the antibodies $V_H$ and/or $V_L$ domains, or antigen-binding site thereof, and are capable of specifically binding to a peptide epitope of HPV 16. In some embodiments, the antibodies include a variable heavy chain and a variable light chain, such as scFvs. The antibodies include antibodies that specifically bind to HPV, e.g., HPV 16 E6 or HPV 16 E7. Among the provided anti-HPV antibodies are human antibodies. The antibodies include isolated antibodies. Also provided are molecules containing such antibodies, e.g., single-chain proteins, fusion proteins, and/or recombinant receptors such as chimeric receptors, including antigen receptors.

The term "antibody" herein is used in the broadest sense and includes polyclonal and monoclonal antibodies, including intact antibodies and functional (antigen-binding) antibody fragments, including fragment antigen binding (Fab) fragments, F(ab')$_2$ fragments, Fab' fragments, Fv fragments, recombinant IgG (rIgG) fragments, variable heavy chain ($V_H$) regions capable of specifically binding the antigen, single chain antibody fragments, including single chain variable fragments (scFv), and single domain antibodies (e.g., sdAb, sdFv, nanobody) fragments. The term encompasses genetically engineered and/or otherwise modified forms of immunoglobulins, such as intrabodies, peptibodies, chimeric antibodies, fully human antibodies, humanized antibodies, and heteroconjugate antibodies, multispecific, e.g., bispecific, antibodies, diabodies, triabodies, and tetrabodies, tandem di-scFv, tandem tri-scFv. Unless otherwise stated, the term "antibody" should be understood to encompass functional antibody fragments thereof. The term also encompasses intact or full-length antibodies, including antibodies of any class or sub-class, including IgG and subclasses thereof, IgM, IgE, IgA, and IgD.

In some embodiments, the heavy and light chains of an antibody can be full-length or can be an antigen-binding portion (a Fab, F(ab')2, Fv or a single chain Fv fragment (scFv)). In other embodiments, the antibody heavy chain constant region is chosen from, e.g., IgG1, IgG2, IgG3, IgG4, IgM, IgA1, IgA2, IgD, and IgE, particularly chosen from, e.g., IgG1, IgG2, IgG3, and IgG4, more particularly, IgG1 (e.g., human IgG1). In another embodiment, the antibody light chain constant region is chosen from, e.g., kappa or lambda, particularly kappa.

Among the provided antibodies are antibody fragments. An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')$_2$; diabodies; linear antibodies; variable heavy chain (V$_H$) regions, single-chain antibody molecules such as scFvs and single-domain V$_H$ single antibodies; and multispecific antibodies formed from antibody fragments. In particular embodiments, the antibodies are single-chain antibody fragments comprising a variable heavy chain region and/or a variable light chain region, such as scFvs.

The term "variable region" or "variable domain", when used in reference to an antibody, such as an antibody fragment, refers to the domain of an antibody heavy or light chain that is involved in binding the antibody to antigen. The variable domains of the heavy chain and light chain (V$_H$ and V$_L$, respectively) of a native antibody generally have similar structures, with each domain comprising four conserved framework regions (FRs) and three CDRs. (See, e.g., Kindt et al. Kuby Immunology, 6th ed., W.H. Freeman and Co., page 91 (2007). A single V$_H$ or V$_L$ domain may be sufficient to confer antigen-binding specificity. Furthermore, antibodies that bind a particular antigen may be isolated using a V$_H$ or V$_L$ domain from an antibody that binds the antigen to screen a library of complementary V$_L$ or V$_H$ domains, respectively. See, e.g., Portolano et al., J. Immunol. 150: 880-887 (1993); Clarkson et al., Nature 352:624-628 (1991).

Single-domain antibodies are antibody fragments comprising all or a portion of the heavy chain variable domain or all or a portion of the light chain variable domain of an antibody. In certain embodiments, a single-domain antibody is a human single-domain antibody.

Antibody fragments can be made by various techniques, including but not limited to proteolytic digestion of an intact antibody as well as production by recombinant host cells. In some embodiments, the antibodies are recombinantly-produced fragments, such as fragments comprising arrangements that do not occur naturally, such as those with two or more antibody regions or chains joined by synthetic linkers, e.g., peptide linkers, and/or that are may not be produced by enzyme digestion of a naturally-occurring intact antibody. In some aspects, the antibody fragments are scFvs.

Among the provided anti-HPV antibodies are human antibodies. A "human antibody" is an antibody with an amino acid sequence corresponding to that of an antibody produced by a human or a human cell, or non-human source that utilizes human antibody repertoires or other human antibody-encoding sequences, including human antibody libraries. The term excludes humanized forms of non-human antibodies comprising non-human antigen-binding regions, such as those in which all or substantially all CDRs are non-human. The term includes antigen-binding fragments of human antibodies.

A "humanized" antibody is an antibody in which all or substantially all CDR amino acid residues are derived from non-human CDRs and all or substantially all FR amino acid residues are derived from human FRs. A humanized antibody optionally may include at least a portion of an antibody constant region derived from a human antibody. A "humanized form" of a non-human antibody, refers to a variant of the non-human antibody that has undergone humanization, typically to reduce immunogenicity to humans, while retaining the specificity and affinity of the parental non-human antibody. In some embodiments, some FR residues in a humanized antibody are substituted with corresponding residues from a non-human antibody (e.g., the antibody from which the CDR residues are derived), e.g., to restore or improve antibody specificity or affinity.

Human antibodies may be prepared by administering an immunogen to a transgenic animal that has been modified to produce intact human antibodies or intact antibodies with human variable regions in response to antigenic challenge. Such animals typically contain all or a portion of the human immunoglobulin loci, which replace the endogenous immunoglobulin loci, or which are present extrachromosomally or integrated randomly into the animal's chromosomes. In such transgenic animals, the endogenous immunoglobulin loci have generally been inactivated. Human antibodies also may be derived from human antibody libraries, including phage display and cell-free libraries, containing antibody-encoding sequences derived from a human repertoire.

Among the provided antibodies are monoclonal antibodies, including monoclonal antibody fragments. The term "monoclonal antibody" as used herein refers to an antibody obtained from or within a population of substantially homogeneous antibodies, i.e., the individual antibodies comprising the population are identical, except for possible variants containing naturally occurring mutations or arising during production of a monoclonal antibody preparation, such variants generally being present in minor amounts. In contrast to polyclonal antibody preparations, which typically include different antibodies directed against different epitopes, each monoclonal antibody of a monoclonal antibody preparation is directed against a single epitope on an antigen. The term is not to be construed as requiring production of the antibody by any particular method. A monoclonal antibody may be made by a variety of techniques, including but not limited to generation from a hybridoma, recombinant DNA methods, phage-display and other antibody display methods.

As used herein, reference to a "corresponding form" of an antibody means that when comparing a property or activity of two antibodies, the property is compared using the same form of the antibody. For example, if it is stated that an antibody has greater activity compared to the activity of the corresponding form of a first antibody, that means that a particular form, such as a scFv of that antibody, has greater activity compared to the scFv form of the first antibody.

"Effector functions" refer to those biological activities attributable to the Fc region of an antibody, which vary with the antibody isotype. Examples of antibody effector functions include: C1q binding and complement dependent cytotoxicity (CDC); Fc receptor binding; antibody-dependent cell-mediated cytotoxicity (ADCC); phagocytosis; down regulation of cell surface receptors (e.g. B cell receptor); and B cell activation.

In some embodiments, the antibody, e.g., antibody fragment, may contain at least a portion of an immunoglobulin constant region, such as one or more constant region domain. In some embodiments, the constant regions include a light chain constant region and/or a heavy chain constant region 1 (C$_H$1). In some embodiments, the antibody includes a C$_H$2 and/or C$_H$3 domain, such as an Fc region. In some embodiments, the Fc region is an Fc region of a human IgG, such as an IgG1 or IgG4.

The term "Fc region" herein is used to define a C-terminal region of an immunoglobulin heavy chain that contains at least a portion of the constant region. The term includes native sequence Fc regions and variant Fc regions. In one embodiment, a human IgG heavy chain Fc region extends from Cys226, or from Pro230, to the carboxyl-terminus of the heavy chain. However, the C-terminal lysine (Lys447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991.

The terms "full length antibody," "intact antibody," and "whole antibody" are used herein interchangeably to refer to an antibody having a structure substantially similar to a native antibody structure or having heavy chains that contain an Fc region as defined herein.

An "isolated" antibody is one which has been separated from a component of its natural environment. In some embodiments, an antibody is purified to greater than 95% or 99% purity as determined by, for example, electrophoretic (e.g., SDS-PAGE, isoelectric focusing (IEF), capillary electrophoresis) or chromatographic (e.g., ion exchange or reverse phase HPLC). For review of methods for assessment of antibody purity, see, e.g., Flatman et al., J. Chromatogr. B 848:79-87 (2007).

1. Variants and Modifications

In certain embodiments, the antibodies or antigen-binding fragments thereof include one or more amino acid variations, e.g., substitutions, deletions, insertions, and/or mutations, compared to the sequence of an antibody described herein. Exemplary variants include those designed to improve the binding affinity and/or other biological properties of the antibody. Amino acid sequence variants of an antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding.

In certain embodiments, the antibodies include one or more amino acid substitutions, e.g., as compared to an antibody sequence described herein and/or compared to a sequence of a natural repertoire, e.g., human repertoire. Sites of interest for substitutional mutagenesis include the CDRs and FRs. Amino acid substitutions may be introduced into an antibody of interest and the products screened for a desired activity, e.g., retained/improved antigen binding, decreased immunogenicity, improved half-life, and/or improved effector function, such as the ability to promote antibody-dependent cellular cytotoxicity (ADCC) or complement-dependent cytotoxicity (CDC).

In some embodiments, one or more residues within a CDR of a parent antibody (e.g. a humanized or human antibody) is/are substituted. In some embodiments, the substitution is made to revert a sequence or position in the sequence to a germline sequence, such as an antibody sequence found in the germline (e.g., human germline), for example, to reduce the likelihood of immunogenicity, e.g., upon administration to a human subject.

In some embodiments, alterations are made in CDR "hotspots," residues encoded by codons that undergo mutation at high frequency during the somatic maturation process (see, e.g., Chowdhury, Methods Mol. Biol. 207:179-196 (2008)), and/or residues that contact antigen, with the resulting variant $V_H$ or $V_L$ being tested for binding affinity. Affinity maturation by constructing and reselecting from secondary libraries has been described, e.g., in Hoogenboom et al. in Methods in Molecular Biology 178:1-37 (O'Brien et al., ed., Human Press, Totowa, N.J., (2001)). In some embodiments of affinity maturation, diversity is introduced into the variable genes chosen for maturation by any of a variety of methods (e.g., error-prone PCR, chain shuffling, or oligonucleotide-directed mutagenesis). A secondary library may then be created and screened to identify any antibody variants with the desired affinity. Another method to introduce diversity involves CDR-directed approaches, in which several CDR residues (e.g., 4-6 residues at a time) are randomized. CDR residues involved in antigen binding may be specifically identified, e.g., using alanine scanning mutagenesis or modeling. CDR-H3 and CDR-L3 in particular are often targeted.

In certain embodiments, substitutions, insertions, or deletions may occur within one or more CDRs so long as such alterations do not substantially reduce the ability of the antibody to bind antigen. For example, conservative alterations (e.g., conservative substitutions as provided herein) that do not substantially reduce binding affinity may be made in CDRs. Such alterations may, for example, be outside of antigen contacting residues in the CDRs. In certain embodiments of the variant $V_H$ and $V_L$ sequences provided above, each CDR either is unaltered, or contains no more than one, two or three amino acid substitutions.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme or a polypeptide which increases the serum half-life of the antibody.

In certain embodiments, the antibody or antigen-binding fragment thereof is altered to increase or decrease the extent to which the antibody is glycosylated, for example, by removing or inserting one or more glycosylation sites by altering the amino acid sequence and/or by modifying the oligosaccharide(s) attached to the glycosylation sites, e.g., using certain cell lines.

Exemplary modifications, variants, and cell lines are described, e.g., in Patent Publication Nos. US 2003/0157108, US 2004/0093621, US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; WO2002/031140; Okazaki et al. J. Mol. Biol. 336:1239-1249 (2004); Yamane-Ohnuki et al. Biotech. Bioeng. 87: 614 (2004). Ripka et al. Arch. Biochem. Biophys. 249:533-545 (1986); US Pat Appl No US 2003/0157108 A1, Presta, L; and WO 2004/056312 A1, Yamane-Ohnuki et al. Biotech. Bioeng. 87: 614 (2004); Kanda, Y. et al., Biotechnol. Bioeng., 94(4):680-688 (2006); and WO2003/085107); WO 2003/011878 (Jean-Mairet et al.); U.S. Pat. No. 6,602,684 (Umana et al.); and US 2005/0123546 (Umana et al.); WO 1997/30087 (Patel et al.); WO 1998/58964 (Raju, S.); and WO 1999/22764 (Raju, S.).

Among the modified antibodies are those having one or more amino acid modifications in the Fc region, such as those having a human Fc region sequence or other portion of a constant region (e.g., a human IgG1, IgG2, IgG3 or IgG4 Fc region) comprising an amino acid modification (e.g., a substitution) at one or more amino acid positions.

Such modifications can be made, e.g., to improve half-life, alter binding to one or more types of Fc receptors, and/or alter effector functions.

Also among the variants are cysteine engineered antibodies such as "thioMAbs" and other cysteine engineered variants, in which one or more residues of an antibody are substituted with cysteine residues, in order to generate reactive thiol groups at accessible sites, e.g., for use in conjugation of agents and linker-agents, to produce immunoconjugates. Cysteine engineered antibodies are described, e.g., in U.S. Pat. Nos. 7,855,275 and 7,521,541.

In some embodiments, the antibodies are modified to contain additional nonproteinaceous moieties, including water soluble polymers. Exemplary polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone) polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer is attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

2. TCR-Like CARs

In some embodiments, the antibody or antigen-binding portion thereof is expressed on cells as part of a recombinant receptor, such as an antigen receptor. Among the antigen receptors are functional non-TCR antigen receptors, such as chimeric antigen receptors (CARs). Generally, a CAR containing an antibody or antigen-binding fragment that exhibits TCR-like specificity directed against a peptide in the context of an MHC molecule also may be referred to as a TCR-like CAR.

Thus, among the provided binding molecules, e.g., HPV 16 E6 or E7 binding molecules, are antigen receptors, such as those that include one of the provided antibodies, e.g., TCR-like antibodies. In some embodiments, the antigen receptors and other chimeric receptors specifically bind to a region or epitope of HPV16 E6 or E7, such as antigen receptors containing the provided anti-HPV 16 E6 or E7 antibodies or antibody fragments, e.g. TCR-like antibodies. Among the antigen receptors are functional non-TCR antigen receptors, such as chimeric antigen receptors (CARs). Also provided are cells expressing the CARs and uses thereof in adoptive cell therapy, such as treatment of diseases and disorders associated with HPV 16 E6 or E7 expression.

Thus, provided herein are TCR-like CARs that contain a non-TCR molecule that exhibits T cell receptor specificity, such as for a T cell epitope or peptide epitope when displayed or presented in the context of an MHC molecule. In some embodiments, a TCR-like CAR can contain an antibody or antigen-binding portion thereof, e.g., TCR-like antibody, such as described herein. In some embodiments, the antibody or antibody-binding portion thereof is reactive against specific peptide epitope in the context of an MHC molecule, wherein the antibody or antibody fragment can differentiate the specific peptide in the context of the MHC molecule from the MHC molecule alone, the specific peptide alone, and, in some cases, an irrelevant peptide in the context of an MHC molecule. In some embodiments, an antibody or antigen-binding portion thereof can exhibit a higher binding affinity than a T cell receptor.

Exemplary antigen receptors, including CARs, and methods for engineering and introducing such receptors into cells, include those described, for example, in international patent application publication numbers WO2000/14257, WO2013/126726, WO2012/129514, WO2014/031687, WO2013/166321, WO2013/071154, WO2013/123061 U.S. patent application publication numbers US2002/131960, US2013/287748, US2013/0149337, U.S. Pat. Nos. 6,451,995, 7,446,190, 8,252,592, 8,339,645, 8,398,282, 7,446,179, 6,410,319, 7,070,995, 7,265,209, 7,354,762, 7,446,191, 8,324,353, and 8,479,118, and European patent application number EP2537416, and/or those described by Sadelain et al., Cancer Discov. 2013 April; 3(4): 388-398; Davila et al. (2013) PLoS ONE 8(4): e61338; Turtle et al., Curr. Opin. Immunol., 2012 October; 24(5): 633-39; Wu et al., Cancer, 2012 Mar. 18(2): 160-75. In some aspects, the antigen receptors include a CAR as described in U.S. Pat. No. 7,446,190, and those described in International Patent Application Publication No.: WO2014/055668 A1. Exemplary of the CARs include CARs as disclosed in any of the aforementioned publications, such as WO2014/031687, U.S. Pat. Nos. 8,339,645, 7,446,179, US 2013/0149337, U.S. Pat. Nos. 7,446,190, 8,389,282, e.g., and in which the antigen-binding portion, e.g., scFv, is replaced by an antibody, e.g., as provided herein.

In some embodiments, the CARs generally include an extracellular antigen (or ligand) binding domain, including as an antibody or antigen-binding fragment thereof specific for a peptide in the context of an MHC molecule, linked to one or more intracellular signaling components, in some aspects via linkers and/or transmembrane domain(s). In some embodiments, such molecules can typically mimic or approximate a signal through a natural antigen receptor, such as a TCR, and, optionally, a signal through such a receptor in combination with a costimulatory receptor.

In some embodiments, the CAR typically includes in its extracellular portion one or more antigen binding molecules, such as one or more antigen-binding fragment, domain, or portion, or one or more antibody variable domains, and/or antibody molecules. In some embodiments, the CAR includes an antigen-binding portion or portions of an antibody molecule, such as a single-chain antibody fragment (scFv) derived from the variable heavy (VH) and variable light (VL) chains of a monoclonal antibody (mAb). In some embodiments, the CAR contains a TCR-like antibody, such as an antibody or an antigen-binding fragment (e.g., scFv) that specifically recognizes a peptide epitope presented on the cell surface in the context of an MHC molecule.

In some aspects, the antigen-specific binding, or recognition component is linked to one or more transmembrane and intracellular signaling domains. In some embodiments, the CAR includes a transmembrane domain fused to the extracellular domain of the CAR. In one embodiment, the transmembrane domain that naturally is associated with one of the domains in the CAR is used. In some instances, the transmembrane domain is selected or modified by amino acid substitution to avoid binding of such domains to the transmembrane domains of the same or different surface membrane proteins to minimize interactions with other members of the receptor complex.

The transmembrane domain in some embodiments is derived either from a natural or from a synthetic source. Where the source is natural, the domain in some aspects is derived from any membrane-bound or transmembrane protein. Transmembrane regions include those derived from (i.e. comprise at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154. Alternatively the transmembrane domain in some embodiments is synthetic. In some aspects, the synthetic transmembrane domain comprises predominantly hydrophobic residues such as leucine and valine. In some aspects, a triplet of phenylalanine, tryptophan and valine will be found at each end of a synthetic transmembrane domain.

In some embodiments, a short oligo- or polypeptide linker, for example, a linker of between 2 and 10 amino acids in length, such as one containing glycines and serines, e.g., glycine-serine doublet, is present and forms a linkage between the transmembrane domain and the cytoplasmic signaling domain of the CAR.

In some embodiments, the CAR, e.g., TCR-like CAR, such as the antibody portion thereof, further includes a spacer, which may be or include at least a portion of an immunoglobulin constant region or variant or modified version thereof, such as a hinge region, e.g., an IgG4 hinge region, and/or a $C_H1/C_L$ and/or Fc region. In some embodiments, the constant region or portion is of a human IgG, such as IgG4 or IgG1. In some aspects, the portion of the constant region serves as a spacer region between the antigen-recognition component, e.g., scFv, and transmembrane domain. The spacer can be of a length that provides for increased responsiveness of the cell following antigen binding, as compared to in the absence of the spacer. In some examples, the spacer is at or about 12 amino acids in length or is no more than 12 amino acids in length. Exemplary spacers include those having at least about 10 to 229 amino acids, about 10 to 200 amino acids, about 10 to 175 amino acids, about 10 to 150 amino acids, about 10 to 125 amino acids, about 10 to 100 amino acids, about 10 to 75 amino acids, about 10 to 50 amino acids, about 10 to 40 amino acids, about 10 to 30 amino acids, about 10 to 20 amino acids, or about 10 to 15 amino acids, and including any integer between the endpoints of any of the listed ranges. In some embodiments, a spacer region has about 12 amino acids or less, about 119 amino acids or less, or about 229 amino acids or less. Exemplary spacers include IgG4 hinge alone, IgG4 hinge linked to $C_H2$ and $C_H3$ domains, or IgG4 hinge linked to the $C_H3$ domain. Exemplary spacers include, but are not limited to, those described in Hudecek et al. (2013) *Clin. Cancer Res.*, 19:3153 or international patent application publication number WO2014/031687.

In some embodiments, the constant region or portion is of a human IgG, such as IgG4 or IgG1. In some embodiments, the spacer has the sequence ESKYGPPCPPCP (set forth in SEQ ID NO: 314), and is encoded by the sequence set forth in SEQ ID NO: 295. In some embodiments, the spacer has the sequence set forth in SEQ ID NO: 296. In some embodiments, the spacer has the sequence set forth in SEQ ID NO: 297. In some embodiments, the constant region or portion is of IgD. In some embodiments, the spacer has the sequence set forth in SEQ ID NO: 298. In some embodiments, the spacer has a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS:296, 297, 298 or 314.

The antigen recognition domain generally is linked to one or more intracellular signaling components, such as signaling components that mimic activation through an antigen receptor complex, such as a TCR complex, in the case of a CAR, and/or signal via another cell surface receptor. Thus, in some embodiments, the antibody or antigen-binding fragment thereof is linked to one or more transmembrane and intracellular signaling domains. In some embodiments, the transmembrane domain is fused to the extracellular domain. In one embodiment, a transmembrane domain that naturally is associated with one of the domains in the receptor, e.g., CAR, is used. In some instances, the transmembrane domain is selected or modified by amino acid substitution to avoid binding of such domains to the transmembrane domains of the same or different surface membrane proteins to minimize interactions with other members of the receptor complex.

The transmembrane domain in some embodiments is derived either from a natural or from a synthetic source. Where the source is natural, the domain in some aspects is derived from any membrane-bound or transmembrane protein. Transmembrane regions include those derived from (i.e. comprise at least the transmembrane region(s) of) the alpha, beta or zeta chain of the T-cell receptor, CD28, CD3 epsilon, CD45, CD4, CD5, CD8, CD9, CD 16, CD22, CD33, CD37, CD64, CD80, CD86, CD134, CD137, CD154. Alternatively the transmembrane domain in some embodiments is synthetic. In some aspects, the synthetic transmembrane domain comprises predominantly hydrophobic residues such as leucine and valine. In some aspects, a triplet of phenylalanine, tryptophan and valine will be found at each end of a synthetic transmembrane domain. In some embodiments, the linkage is by linkers, spacers, and/or transmembrane domain(s).

Among the intracellular signaling domains are those that mimic or approximate a signal through a natural antigen receptor, a signal through such a receptor in combination with a costimulatory receptor, and/or a signal through a costimulatory receptor alone. In some embodiments, a short oligo- or polypeptide linker, for example, a linker of between 2 and 10 amino acids in length, such as one containing glycines and serines, e.g., glycine-serine doublet, is present and forms a linkage between the transmembrane domain and the cytoplasmic signaling domain of the CAR.

The CAR generally includes at least one intracellular signaling component or components. In some embodiments, the CAR includes an intracellular component of the TCR complex, such as a TCR CD3$^+$ chain that mediates T-cell activation and cytotoxicity, e.g., CD3 zeta chain. Thus, in some aspects, the antigen binding molecule is linked to one or more cell signaling modules. In some embodiments, cell signaling modules include CD3 transmembrane domain, CD3 intracellular signaling domains, and/or other CD transmembrane domains. In some embodiments, the CAR further includes a portion of one or more additional molecules such as Fc receptor γ, CD8, CD4, CD25, or CD16. For example, in some aspects, the CAR includes a chimeric molecule between CD3-zeta (CD3-ζ) or Fc receptor γ and CD8, CD4, CD25 or CD16.

In some embodiments, upon ligation of the CAR, the cytoplasmic domain or intracellular signaling domain of the CAR activates at least one of the normal effector functions or responses of the immune cell, e.g., T cell engineered to express the CAR. For example, in some contexts, the CAR induces a function of a T cell such as cytolytic activity or T-helper activity, such as secretion of cytokines or other factors. In some embodiments, a truncated portion of an intracellular signaling domain of an antigen receptor component or costimulatory molecule is used in place of an intact immunostimulatory chain, for example, if it transduces the effector function signal. In some embodiments, the intracellular signaling domain or domains include the cytoplasmic sequences of the T cell receptor (TCR), and in some aspects also those of co-receptors that in the natural context act in concert with such receptor to initiate signal transduction following antigen receptor engagement, and/or any derivative or variant of such molecules, and/or any synthetic sequence that has the same functional capability.

In the context of a natural TCR, full activation generally requires not only signaling through the TCR, but also a costimulatory signal. Thus, in some embodiments, to promote full activation, a component for generating secondary or co-stimulatory signal is also included in the CAR. In other embodiments, the CAR does not include a component for generating a costimulatory signal. In some aspects, an additional CAR is expressed in the same cell and provides the component for generating the secondary or costimulatory signal. In some aspects, the cell comprises a first CAR which contains signaling domains to induce the primary signal and a second CAR which binds to a second antigen and contains the component for generating a costimulatory signal. For example, a first CAR can be an activating CAR and the second CAR can be a costimulatory CAR. In some aspects, both CARs must be ligated in order to induce a particular effector function in the cell, which can provide specificity and selectivity for the cell type being targeted.

T cell activation is in some aspects described as being mediated by two classes of cytoplasmic signaling sequences: those that initiate antigen-dependent primary activation through the TCR (primary cytoplasmic signaling sequences), and those that act in an antigen-independent manner to provide a secondary or co-stimulatory signal (secondary cytoplasmic signaling sequences). In some aspects, the CAR includes one or both of such signaling components.

In some aspects, the CAR includes a primary cytoplasmic signaling sequence that regulates primary activation of the TCR complex. Primary cytoplasmic signaling sequences that act in a stimulatory manner may contain signaling motifs which are known as immunoreceptor tyrosine-based activation motifs or ITAMs. Examples of ITAM containing primary cytoplasmic signaling sequences include those derived from TCR or CD3 zeta, FcR gamma, CD3 gamma, CD3 delta or CD3 epsilon. In some embodiments, cytoplasmic signaling molecule(s) in the CAR contain(s) a cytoplasmic signaling domain, portion thereof, or sequence derived from CD3 zeta.

In some embodiments, the CAR includes a signaling domain and/or transmembrane portion of a costimulatory receptor, such as CD28, 4-1BB, OX40, DAP10, and ICOS. In some aspects, the same CAR includes both the activating and costimulatory components; in other aspects, the activating domain is provided by one CAR whereas the costimulatory component is provided by another CAR recognizing another antigen.

In some embodiments, the activating domain is included within one CAR, whereas the costimulatory component is provided by another chimeric receptor recognizing another antigen. In some embodiments, the CARs include activating or stimulatory CARs, and costimulatory receptors, both expressed on the same cell (see WO2014/055668). In some aspects, the HPV 16 E6 or E7 antibody-containing receptor is the stimulatory or activating CAR; in other aspects, it is the costimulatory receptor. In some embodiments, the cells further include inhibitory CARs (iCARs, see Fedorov et al., *Sci. Transl. Medicine,* 5(215) (December, 2013)), such as an inhibitory receptor recognizing a peptide epitope other than HPV 16 E6 or HPV16 E7, whereby an activating signal delivered through the HPV 16-targeting CAR is diminished or inhibited by binding of the inhibitory CAR to its ligand, e.g., to reduce off-target effects.

In some embodiments, the cell expressing the provided TCR or other binding molecule further expresses an additional receptor, such as a receptor capable of delivering a costimulatory or survival-promoting signal, such as a costimulatory receptor (see WO2014/055668) and/or to block or change the outcome of an inhibitory signal, such as one typically delivered via an immune checkpoint or other immunoinhibitory molecule, such as one expressed in the tumor microenvironment, e.g., in order to promote increased efficacy of such engineered cells. See, e.g., Tang et al., Am J Transl Res. 2015; 7(3): 460-473. In some embodiments, the cell may further include one or more other exogenous or recombinant or engineered components, such as one or more exogenous factors and/or costimulatory ligands, which are expressed on or in or secreted by the cells and can promote function, e.g., in the microenvironment. Exemplary of such ligands and components include, e.g., TNFR and/or Ig family receptors or ligands, e.g., 41BBL, CD40, CD40L, CD80, CD86, cytokines, chemokines, and/or antibodies or other molecules, such as scFvs. See, e.g., patent application publication Nos WO2008121420 A1, WO2014134165 A1, US20140219975 A1. In some embodiments, the cells comprise one or more inhibitory receptor (iCARs, see Fedorov et al., *Sci. Transl. Medicine,* 5(215) (December, 2013)), such as one that binds to a ligand or antigen not associated with the disease or condition or not expressed therein or thereon.

In certain embodiments, the intracellular signaling domain comprises a CD28 transmembrane and signaling domain linked to a CD3 (e.g., CD3-zeta) intracellular domain. In some embodiments, the intracellular signaling domain comprises a chimeric CD28 and CD137 (4-1BB, TNFRSF9) co-stimulatory domains, linked to a CD3 zeta intracellular domain.

In some embodiments, the CAR encompasses one or more, e.g., two or more, costimulatory domains and an activation domain, e.g., primary activation domain, in the cytoplasmic portion. Exemplary CARs include intracellular components of CD3-zeta, CD28, and 4-1BB.

In some embodiments, the cell expressing the CAR or other antigen receptor further includes a surrogate marker, such as a cell surface marker, which may be used to confirm transduction or engineering of the cell to express the receptor, such as a truncated version of a cell surface receptor. In some aspects, the marker includes all or part (e.g., truncated form) of CD34, a NGFR, Her2 or epidermal growth factor receptor (e.g., tEGFR). In some embodiments, the nucleic acid encoding the marker is operably linked to a polynucleotide encoding for a linker sequence, such as a cleavable linker sequence, e.g., T2A. See WO2014031687. In some embodiments, introduction of a construct encoding the CAR and surrogate marker separated by a T2A ribosome switch can express two proteins from the same construct, such that the surrogate marker can be used as a marker to detect cells expressing such construct. In some embodiments, a marker, and optionally a linker sequence, can be any as disclosed in published patent application No. WO2014031687. For example, the marker can be a truncated cell surface receptor that is, optionally, linked to a linker sequence, such as a T2A cleavable linker sequence. An exemplary polypeptide for a truncated EGFR (e.g. tEGFR) comprises the sequence of amino acids set forth in SEQ ID NO: 299 or 300 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 299 or 300. An exemplary T2A linker sequence comprises the sequence of amino acids set forth in SEQ ID NO: 302 or 301 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 302 or 301.

In some embodiments, the marker is a molecule, e.g., cell surface protein, not naturally found on T cells or not naturally found on the surface of T cells, or a portion thereof.

In some embodiments, the molecule is a non-self molecule, e.g., non-self protein, i.e., one that is not recognized as "self" by the immune system of the host into which the cells will be adoptively transferred.

In some embodiments, the marker serves no therapeutic function and/or produces no effect other than to be used as a marker for genetic engineering, e.g., for selecting cells successfully engineered. In other embodiments, the marker may be a therapeutic molecule or molecule otherwise exerting some desired effect, such as a ligand for a cell to be encountered in vivo, such as a costimulatory or immune checkpoint molecule to enhance and/or dampen responses of the cells upon adoptive transfer and encounter with ligand.

In some cases, CARs are referred to as first, second, and/or third generation CARs. In some aspects, a first generation CAR is one that solely provides a CD3-chain induced signal upon antigen binding; in some aspects, a second-generation CARs is one that provides such a signal and costimulatory signal, such as one including an intracellular signaling domain from a costimulatory receptor such as CD28 or CD137; in some aspects, a third generation CAR in some aspects is one that includes multiple costimulatory domains of different costimulatory receptors.

In some embodiments, the chimeric antigen receptor includes an extracellular portion containing a TCR-like antibody or fragment described herein and an intracellular signaling domain. In some embodiments, the antibody or fragment includes an scFv and the intracellular domain contains an ITAM. In some aspects, the intracellular signaling domain includes a signaling domain of a zeta chain of a CD3-zeta (CD3) chain. In some embodiments, the chimeric antigen receptor includes a transmembrane domain linking the extracellular domain and the intracellular signaling domain. In some aspects, the transmembrane domain contains a transmembrane portion of CD28. The extracellular domain and transmembrane can be linked directly or indirectly. In some embodiments, the extracellular domain and transmembrane are linked by a spacer, such as any described herein. In some embodiments, the chimeric antigen receptor contains an intracellular domain of a T cell costimulatory molecule, such as between the transmembrane domain and intracellular signaling domain. In some aspects, the T cell costimulatory molecule is CD28 or 41BB.

For example, in some embodiments, the CAR contains a TCR-like antibody, e.g., an antibody fragment, as provided herein, a transmembrane domain that is or contains a transmembrane portion of CD28 or a functional variant thereof, and an intracellular signaling domain containing a signaling portion of CD28 or functional variant thereof and a signaling portion of CD3 zeta or functional variant thereof. In some embodiments, the CAR contains a TCR-like antibody, e.g., antibody fragment, as provided herein, a transmembrane domain that is or contains a transmembrane portion of CD28 or a functional variant thereof, and an intracellular signaling domain containing a signaling portion of a 4-1BB or functional variant thereof and a signaling portion of CD3 zeta or functional variant thereof. In some such embodiments, the CAR further includes a spacer containing a portion of an Ig molecule, such as a human Ig molecule, such as an Ig hinge, e.g. an IgG4 hinge, such as a hinge-only spacer.

In some embodiments, the transmembrane domain of the receptor, e.g., the TCR-like CAR, is a transmembrane domain of human CD28 (e.g., Accession No. P01747.1) or variant thereof, such as a transmembrane domain that comprises the sequence of amino acids set forth in SEQ ID NO: 303 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 303. In some embodiments, the transmembrane-domain containing portion of the CAR comprises the sequence of amino acids set forth in SEQ ID NO: 304 or a sequence of amino acids having at least at or about 85%, 86%, 87%, 88%, 89%, 90%, 91%, 92%, 93%, 94%, 95%, 96%, 97%, 98%, 99% or more sequence identity to SEQ ID NO: 304.

In some embodiments, the intracellular signaling component(s) of the CAR, e.g., the TCR-like CAR, contains an intracellular costimulatory signaling domain of human CD28 or a functional variant or portion thereof, such as a domain with an LL to GG substitution at positions 186-187 of a native CD28 protein. For example, the intracellular signaling domain can comprise the sequence of amino acids set forth in SEQ ID NO: 305 or 306 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 305 or 306. In some embodiments, the intracellular domain comprises an intracellular costimulatory signaling domain of 4-1BB (e.g. (Accession No. Q07011.1) or functional variant or portion thereof, such as the sequence of amino acids set forth in SEQ ID NO: 307 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 307.

In some embodiments, the intracellular signaling domain of the CAR, e.g. the TCR-like CAR, comprises a human CD3 zeta stimulatory signaling domain or functional variant thereof, such as an 112 AA cytoplasmic domain of isoform 3 of human CD3ζ (Accession No.: P20963.2) or a CD3 zeta signaling domain as described in U.S. Pat. No. 7,446,190 or 8,911,993. For example, in some embodiments, the intracellular signaling domain comprises the sequence of amino acids of SEQ ID NO: 308, 309, or 310, or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 308, 309, or 310.

In some aspects, the spacer contains only a hinge region of an IgG, such as only a hinge of IgG4 or IgG1, such as the hinge only spacer set forth in SEQ ID NO: 314. In other embodiments, the spacer is or contains an Ig hinge, e.g., an IgG4-derived hinge, optionally linked to a CH2 and/or CH3 domains. In some embodiments, the spacer is an Ig hinge, e.g., an IgG4 hinge, linked to CH2 and CH3 domains, such as set forth in SEQ ID NO: 297. In some embodiments, the spacer is an Ig hinge, e.g., an IgG4 hinge, linked to a CH3 domain only, such as set forth in SEQ ID NO: 296. In some embodiments, the spacer is or comprises a glycine-serine rich sequence or other flexible linker such as known flexible linkers.

For example, in some embodiments, the TCR-like CAR includes a TCR-like antibody or fragment, such as any provided herein, including scFvs, a spacer such as any of the Ig-hinge containing spacers, a CD28 transmembrane domain, a CD28 intracellular signaling domain, and a CD3 zeta signaling domain. In some embodiments, the TCR-like CAR includes the α TCR-like antibody or fragment, such as any provided herein, including scFvs, a spacer such as any of the Ig-hinge containing spacers, a CD28 transmembrane domain, a CD28 intracellular signaling domain, and a CD3 zeta signaling domain. In some embodiments, such TCR-like CAR constructs further includes a T2A ribosomal skip element and/or a tEGFR sequence, e.g., downstream of the CAR.

In some embodiments, such CAR constructs further includes a T2A ribosomal skip element and/or a tEGFR sequence, e.g., downstream of the CAR, such as set forth in SEQ ID NO: 301 or 302 and a tEGFR sequence set forth in SEQ ID NO: 299 or 300, or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 299, 300, 301, or 302.

In some embodiments, the CAR includes an HPV 16 E6 or E7 antibody or fragment, such as any of the HPV16 E6 or E7 antibodies, including sdAbs (e.g. containing only the $V_H$ region) and scFvs, described herein, a spacer such as any of the Ig-hinge containing spacers, a CD28 transmembrane domain, a CD28 intracellular signaling domain, and a CD3 zeta signaling domain. In some embodiments, the CAR includes the HPV 16 antibody or fragment, such as any of the HPV 16 E6 or E7 antibodies, including sdAbs and scFvs described herein, a spacer such as any of the Ig-hinge containing spacers, a CD28 transmembrane domain, a CD28 intracellular signaling domain, and a CD3 zeta signaling domain. In some embodiments, such CAR constructs further includes a T2A ribosomal skip element and/or a tEGFR sequence, e.g., downstream of the CAR.

II. NUCLEIC ACIDS, VECTORS AND METHODS OF EXPRESSION

Also provided are nucleic acids encoding any of the provided binding molecules, e.g., TCRs or antigen-binding fragments thereof or antibodies or antigen-binding fragments thereof or CARs containing such antibodies, such as those described herein. The nucleic acids may include those encompassing natural and/or non-naturally occurring nucleotides and bases, e.g., including those with backbone modifications. The terms "nucleic acid molecule," "nucleic acid," and "polynucleotide" may be used interchangeably, and refer to a polymer of nucleotides. Such polymers of nucleotides may contain natural and/or non-natural nucleotides, and include, but are not limited to, DNA, RNA, and PNA. "Nucleic acid sequence" refers to the linear sequence of nucleotides that comprise the nucleic acid molecule or polynucleotide.

In some embodiments, the binding molecule, e.g. TCR, or antigen binding portion thereof may be a recombinantly produced natural protein or mutated form thereof in which one or more property, such as binding characteristic, has been altered. In some aspects, the nucleic acid is synthetic. In some cases, the nucleic acid is or contains cDNA. In some aspects, the nucleic acid molecule can be modified for use in the constructs described herein, such as for codon optimization. In some cases, the sequences can be designed to contain terminal restriction site sequences for purposes of cloning into vectors.

In some embodiments, nucleic acid molecule encoding the binding molecule, e.g. TCR, can be obtained from a variety of sources, such as by polymerase chain reaction (PCR) amplification of encoding nucleic acids within or isolated from a given cell or cells. In some embodiments, the TCR is obtained from a biological source, such as from cells such as from a T cell (e.g. cytotoxic T cell), T cell hybridomas or other publicly available source. In some embodiments, a TCR may be derived from one of various animal species, such as human, mouse, rat, or other mammal, such as generally from a human. In some embodiments, the T cells can be obtained from in vivo isolated cells, such as from normal (or healthy) subjects or diseased subjects, including T cells present in peripheral blood mononuclear cells (PBMCs) or tumor-infiltrating lymphocytes (TILs). In some embodiments, the T cells can be a cultured T cell hybridoma or clone. For example, in some embodiments, to generate a vector encoding a TCR, the α and β chains can be PCR amplified from total cDNA isolated from a T cell clone expressing the TCR of interest and cloned into an expression vector. In some embodiments, the α and β chains can be synthetically generated. In some embodiments, the α and β chains are cloned into the same vector.

In some embodiments, the TCR or antigen-binding portion thereof can be synthetically generated from knowledge of the sequence of the TCR.

In some embodiments, the nucleic acid molecule contains a nucleic acid sequence encoding an alpha chain and/or a nucleotide sequence encoding a beta chain.

In some embodiments, the nucleic acid sequence encoding the alpha chain comprises one of the following: residues 103-870 of SEQ ID NO: 1; residues 103-858 of SEQ ID NO: 2, residues 55-810 of SEQ ID NO: 39, residues 55-789 of SEQ ID NO: 40, residues 67-825 of SEQ ID NO: 71, residues 67-813 of SEQ ID NO: 72, residues 73-831 of SEQ ID NO: 97, residues 73-819 of SEQ ID NO: 98, residues 67-837 of SEQ ID NO: 120, residues 67-825 of SEQ ID NO: 121, residues 67-828 of SEQ ID NO: 143, residues 67-816 of SEQ ID NO: 144, residues 61-819 of SEQ ID NO: 163, residues 61-807 of SEQ ID NO: 164, residues 61-816 of SEQ ID NO: 189, residues 61-804 of SEQ ID NO: 190, residues 67-840 of SEQ ID NO: 215, or residues 67-828 of SEQ ID NO: 216, residues 64-828 of SEQ ID NO: 241, residues 64-816 of SEQ ID NO: 242, a degenerate sequence thereof or a sequence having at least 90%, 91%, 92%, 93%, 94%, 95%, 96%, 97%, 98%, 99% or more sequence identity thereto. In some aspects, the nucleotide sequence encoding the beta chain comprises one of the following: residues 73-957 of SEQ ID NO: 16, residues 73-957 of SEQ ID NO: 17, residues 43-924 of SEQ ID NO: 52, residues 43-912 of SEQ ID NO: 53, residues 58-930 of SEQ ID NO: 82, residues 58-918 of SEQ ID NO: 83, residues 58-930 of SEQ ID NO: 108, residues 58-918 of SEQ ID NO: 109, residues 58-930 of SEQ ID NO: 131, residues 58-918 of SEQ ID NO: 132, residues 58-930 of SEQ ID NO: 151, residues 58-918 of SEQ ID NO: 152, residues 58-942 of SEQ ID NO: 174, residues 58-930 of SEQ ID NO: 175, residues 58-939 of SEQ ID NO: 200, residues 58-927 of SEQ ID NO: 201, residues 58-933 of SEQ ID NO: 226, residues 58-921 of SEQ ID NO: 227, residues 58-936 of SEQ ID NO: 252 residues 58-924 of SEQ ID NO: 253, a degenerate sequence thereof or a sequence having at least 90%, 91%, 92%, 93%, 94%, 95%, 96%, 97%, 98%, 99% or more sequence identity thereto.

In some embodiments, the nucleotide sequence encoding the alpha chain and/or the nucleotide sequence encoding the beta chain is codon-optimized. Typically, codon optimization involves balancing the percentages of codons selected with the published abundance of human transfer RNAs so that none is overloaded or limiting. This may be necessary in some cases because most amino acids are encoded by more than one codon, and codon usage varies from organism to organism. Differences in codon usage between transfected genes and host cells can have effects on protein expression and immunogenicity of a nucleic acid construct. In general, for codon optimization, codons are chosen to select for those codons that are in balance with human usage frequency. Typically, the redundancy of the codons for amino acids is such that different codons code for one amino acid. In some embodiments, in selecting a codon for replacement, it may be desired that the resulting mutation is a silent mutation such that the codon change does not affect the amino acid sequence. Generally, the last nucleotide of the codon can remain unchanged without affecting the amino acid sequence. In some cases, the nucleic acid sequence encoding binding molecules, e.g., TCRs or antigen-binding fragment thereof, are modified such that cryptic splice sites are removed. In some embodiments, provided herein is a polynucleotide encoding a TCR set forth in SEQ ID NO: 365.

In some cases, the nucleic acid sequence encoding the alpha chain contains one of the following: residues 103-907 of SEQ ID NO: 3, residues 103-895 of SEQ ID NO: 4, residues 55-810 of SEQ ID NO: 41, residues 55-789 of SEQ ID NO: 42, a degenerate sequence thereof or a sequence having at least 90%, 91%, 92%, 93%, 94%, 95%, 96%, 97%, 98%, 99% or more sequence identity thereto. In some examples, the nucleotide sequence encoding the beta chain contains one of the following: residues 82-966 of SEQ ID NO: 18, residues 82-954 of SEQ ID NO: 19, residues 43-924 of SEQ ID NO: 54, residues 43-912 of SEQ ID NO: 55, a degenerate sequence thereof or a sequence having at least 90%, 91%, 92%, 93%, 94%, 95%, 96%, 97%, 98%, 99% or more sequence identity thereto.

In some embodiments, the nucleic acid molecule encoding an alpha chain and/or beta chain of a TCR comprises a nucleic acid sequence corresponding to a SEQ ID NO: set forth in Table 7. Also among the provided nucleic acid molecules encoding a TCR are those containing sequences at least at or about 90, 91, 92, 93, 94, 95, 96, 97, 98, or 99% identical to such sequences. Also provided are any of the TCR alpha chains encoded by any of the sequences set forth in Table 7, such as in each row therein. Also provided are any of the TCR beta chains encoded by any of the sequences set forth in Table 7, such as in each row therein. Also provided are any of the TCR alpha and beta chains encoded by any of the sequences set forth in Table 7, such as in each row therein. Exemplary TCRs encoded by such sequences, or their modified versions, also are set forth in the Table 7.

TABLE 7

HPV16 E6 & E7 TCR Nucleotide SEQ ID NOs.

| Exemplary TCR or modified version thereof | Alpha | | | | Beta | | | |
|---|---|---|---|---|---|---|---|---|
| | Human Constant | | Mouse Constant | | Human Constant | | Mouse Constant | |
| | Native | Codon-Optimized | Native | Codon-Optimized | Native | Codon-Optimized | Native | Codon-Optimized |
| TCR 56 | 1 | 3 or 420 | 2 | 4 or 421 | 16 | 18 | 17 | 19 |
| TCR 57 | 39 | 41 | 40 | 42 | 52 | 54 | 53 | 55 |
| TCR 58 | 71 | — | 72 | — | 82 | — | 83 | — |
| TCR 59 | 97 | — | 98 | — | 108 | — | 109 | — |
| TCR 60 | 120 | — | 121 | — | 131 | — | 132 | — |
| TCR 61 | 143 | — | 144 | — | 151 | — | 152 | — |
| TCR 62 | 163 | — | 164 | — | 174 | — | 175 | — |
| TCR 63 | 189 | — | 190 | — | 200 | — | 201 | — |
| TCR 64 | 215 | — | 216 | — | 226 | — | 227 | — |
| TCR 65 | 241 | — | 242 | — | 252 | — | 253 | — |
| TCR 56 | 1 | 420 | 2 | 421 | 411 | 412 | 17 | 19 |
| TCR 57 | 39 | 41 | 40 | 42 | 361 | 413 | 53 | 55 |
| TCR 58 | 71 | — | 72 | — | 414 | — | 83 | — |
| TCR 59 | 97 | — | 98 | — | 415 | — | 109 | — |
| TCR 60 | 120 | — | 121 | — | 416 | — | 132 | — |
| TCR 61 | 143 | — | 144 | — | 417 | — | 152 | — |
| TCR 62 | 163 | — | 164 | — | 418 | — | 175 | — |
| TCR 63 | 189 | — | 190 | — | 419 | — | 201 | — |
| TCR 64 | 215 | — | 216 | — | 423 | — | 227 | — |
| TCR 65 | 241 | — | 242 | — | 424 | — | 253 | — |

In some embodiments, provided herein is a nucleic acid(s) encoding an alpha chain of a TCR that is set forth in SEQ ID NO:39 and/or a beta chain of a TCR that is set forth in SEQ ID NO:52. In some embodiments, provided herein is a nucleic acid(s) encoding an alpha chain of a TCR that is set forth in SEQ ID NO:39 and/or a beta chain of a TCR that is set forth in SEQ ID NO: 361. In some embodiments, provided herein is a polynucleotide encoding a TCR set forth in SEQ ID NO: 69. In some embodiments, provided herein is a polynucleotide encoding a TCR set forth in SEQ ID NO: 363. In some embodiments, provided herein is a polynucleotide encoding a TCR set forth in SEQ ID NO: 389. In some embodiments, provided herein is a polynucleotide encoding a TCR set forth in SEQ ID NO: 365. In some embodiments, provided herein is a polynucleotide encoding a TCR set forth in SEQ ID NO: 402. Also among the provided nucleic acid(s) or polynucleotides provided herein are those containing sequences at least at or about 90, 91, 92, 93, 94, 95, 96, 97, 98, or 99% identical to such sequences.

In some embodiments, provided herein is a nucleic acid(s) encoding an alpha chain of a TCR set forth in SEQ ID NO:1, 39, 71, 97, 120, 143, 163, 189, 215 or 241 and/or a nucleic acid(s) encoding a beta chain of a TCR set forth in SEQ ID NO:411, 361, 414, 415, 416, 417, 418, 419, 423 or 424. Also among the provided nucleic acid(s) or polynucleotides provided herein are those containing sequences at least at or about 90, 91, 92, 93, 94, 95, 96, 97, 98, or 99% identical to such sequences. Also among the provided embodiments are one or more chains (e.g., alpha chain and/or beta chain) of a TCR or a binding fragment thereof encoded by any of such polynucleotides.

Also provided are vectors or constructs containing such nucleic acid molecules. In some embodiments, the vectors or constructs contain one or more promoters operatively linked to the nucleotide encoding the alpha chain and/or beta chain. In some embodiments, the promoter is operatively linked to one or more than one nucleic acid molecule.

In some embodiments, the vector or construct can contain a single promoter that drives the expression of one or more nucleic acid molecules. In some embodiments, such promoters can be multicistronic (bicistronic or tricistronic, see e.g., U.S. Pat. No. 6,060,273). For example, in some embodiments, transcription units can be engineered as a bicistronic unit containing an IRES (internal ribosome entry site), which allows coexpression of gene products (e.g. encoding an alpha chain and/or beta chain of a TCR) by a message from a single promoter. Alternatively, in some cases, a single promoter may direct expression of an RNA that contains, in a single open reading frame (ORF), two or three genes (e.g. encoding an alpha chain and/or beta chain of a TCR) separated from one another by sequences encoding a self-cleavage peptide (e.g., T2A) or a protease recognition site (e.g., furin). The ORF thus encodes a single polyprotein, which, either during (in the case of 2A e.g., T2A) or after translation, is cleaved into the individual proteins. In some cases, the peptide, such as T2A, can cause the ribosome to skip (ribosome skipping) synthesis of a peptide bond at the C-terminus of a 2A element, leading to separation between the end of the 2A sequence and the next peptide downstream (see, for example, de Felipe. *Genetic Vaccines and Ther.* 2:13 (2004) and deFelipe et al. *Traffic* 5:616-626 (2004)). Examples of 2A cleavage peptides, including those that can induce ribosome skipping, are Thosea asigna virus (T2A, e.g., SEQ ID NO:301 or 302), porcine teschovirus-1 (P2A, e.g., SEQ ID NO: 32 or 311), equine rhinitis A virus (E2A, e.g., SEQ ID NO: 313) and 2A sequences from the foot-and-mouth disease virus (F2A, e.g., SEQ ID NO: 312) as described in U.S. Patent Publication No. 2007/0116690.

In some cases, the nucleotide sequence encoding the alpha chain and the nucleotide sequence encoding the beta chain are separated by a nucleotide sequence encoding an internal ribosome entry site (IRES) or a peptide sequence that causes ribosome skipping. In some instances, the nucleotide sequence encoding the alpha chain and the nucleotide sequence encoding the beta chain are separated by a peptide sequence that causes ribosome skipping. In some such instances, the peptide that causes ribosome skipping is a P2A or T2A peptide and/or contains the sequence of amino acids set forth in SEQ ID NO: 32, 301, 302, or 311. In some aspects, the nucleotide sequence encoding the peptide that causes ribosome skipping contains the sequence set forth in SEQ ID NO: 31, or 315-326.

In some embodiments, the nucleic acid sequence encoding the alpha chain and the nucleotide sequence encoding the beta chain are present in any order, separated by the nucleotide sequence encoding an internal ribosome entry site (IRES) or a peptide sequence that causes ribosome skipping. For example, in some embodiments, the nucleic acid molecule comprises a nucleic acid sequence encoding a beta chain, a nucleic acid sequence encoding an IRES or peptide sequence that causes ribosome skipping, e.g., a P2A or T2A sequence as described herein, and a nucleic acid sequence that encodes an alpha chain, in that order. In other embodiments, the nucleic acid molecule contains a nucleic acid sequence that encodes an alpha chain, a nucleic acid sequence that encodes an IRES or peptide sequence that causes ribosome skipping, and a nucleic acid sequence that encodes a beta chain, in that order.

Thus, in some aspects, the nucleic acid molecule encodes a polypeptide comprising a beta chain, an IRES or peptide that causes ribosome skipping, and an alpha chain, in that order. In other aspects, the nucleic acid molecule encodes a polypeptide comprising an alpha chain, an IRES or peptide that causes ribosome skipping, and a beta chain, in that order.

In some embodiments, the nucleic acid molecule encodes a polypeptide containing an amino acid sequence set forth in Table 8, or a sequence having at least 90%, 91%, 92%, 93%, 94%, 95%, 96%, 97%, 98%, or 99% sequence identity thereto. In some embodiments, the nucleic acid molecule encodes a polypeptide set forth in any of SEQ ID NOS: 37, 38, 69, 70, 95, 96, 118, 119, 141, 142, 161, 162, 187, 188, 213, 214, 239, 240, 265, or 266, or a sequence having at least 90%, 91%, 92%, 93%, 94%, 95%, 96%, 97%, 98%, or 99% sequence identity thereto. In some embodiments, the nucleic acid molecule comprises the nucleic acid sequence set forth in any of SEQ ID NOs: 33-36, 65-68, 93, 94, 116, 117, 139, 140, 159, 160, 185, 186, 211, 212, 237, 238, 263, 264, or a sequence having at least 90%, 91%, 92%, 93%, 94%, 95%, 96%, 97%, 98%, or 99% sequence identity thereto. In some embodiments, provided herein is a polynucleotide encoding a TCR set forth in any one of SEQ ID NOS: 400, 363, 403, 404, 405, 406, 407, 408, 409 or 410. In some embodiments, provided herein is a polynucleotide encoding a TCR set forth in any one of SEQ ID NOS: 364, 65, 93, 116, 139, 159, 185, 211, 237 or 263. In some embodiments, provided herein is a polynucleotide encoding a TCR set forth in any one of SEQ ID NOS: 387, 389, 391, 392, 393, 394, 395, 396, 397 or 398. In some embodiments, provided herein is a polynucleotide encoding a TCR set forth in SEQ ID NO: 399. In some embodiments, provided herein is a polynucleotide encoding a TCR set forth in SEQ ID NO: 67. In some embodiments, provided herein is a polynucleotide encoding a TCR set forth in SEQ ID NO: 388. In some embodiments, provided herein is a polynucleotide encoding a TCR set forth in SEQ ID NO: 390. In some embodiments, provided herein is a polynucleotide encoding a TCR set forth in SEQ ID NO: 401. In some embodiments, provided herein is a polynucleotide encoding a TCR set forth in SEQ ID NO: 402. Also among the provided nucleic acid(s) or polynucleotides provided herein are those containing sequences at least at or about 90, 91, 92, 93, 94, 95, 96, 97, 98, or 99% identical to such sequences. Also among the provided embodiments are one or more chains (e.g., alpha chain and/or beta chain) of a TCR or a binding fragment thereof encoded by any of such polynucleotides.

Also provided are polypeptides containing a sequence encoded by any of the provided nucleic acids. In some aspects, the polypeptide comprises an amino acid sequence corresponding to a SEQ ID NO. shown in Table 8, or a sequence having at least 90%, 91%, 92%, 93%, 94%, 95%, 96%, 97%, 98%, or 99% sequence identity thereto. In some embodiments, the polypeptide comprises the sequence set forth in any of SEQ ID NOS: 37, 38, 69, 70, 95, 96, 118, 119, 141, 142, 161, 162, 187, 188, 213, 214, 239, 240, 265, or 266, or a sequence having at least 90%, 91%, 92%, 93%, 94%, 95%, 96%, 97%, 98%, or 99% sequence identity thereto. In some embodiments, the polypeptide comprises the sequence set forth in SEQ ID NOS: 362, or a sequence having at least 90%, 91%, 92%, 93%, 94%, 95%, 96%, 97%, 98%, or 99% sequence identity thereto. Exemplary of such TCRs, or their modified versions, also are set forth in the Table 8.

TABLE 8

HPV16 E6 & E7 TCR SEQ ID NOs.

| Exemplary TCR or modified version | Full Encoded Amino Acid | | Full Nucleotide | | | |
|---|---|---|---|---|---|---|
| | Human Constant | Mouse Constant | Native Human | Native Mouse | Codon-opt/ modified Human | Codon-opt/ modified Mouse |
| TCR 56 | 37 | 38 | 33 or 364 | 34 | 35 or 399 | 36 or 422 |
| TCR 57 | 69 | 70 | 65 | 66 | 67 | 68 |
| TCR 58 | 95 | 96 | 93 | 94 | — | — |
| TCR 59 | 118 | 119 | 116 | 117 | — | — |
| TCR 60 | 141 | 142 | 139 | 140 | — | — |
| TCR 61 | 161 | 162 | 159 | 160 | — | — |
| TCR 62 | 187 | 188 | 185 | 186 | — | — |
| TCR 63 | 213 | 214 | 211 | 212 | — | — |
| TCR 64 | 239 | 240 | 237 | 238 | — | — |
| TCR 65 | 265 | 266 | 263 | 264 | — | — |
| TCR 56 | — | — | 400 | — | — | — |
| TCR 57 | 362 | — | 363 | — | — | — |
| TCR 58 | — | — | 403 | — | — | — |
| TCR 59 | — | — | 404 | — | — | — |
| TCR 60 | — | — | 405 | — | — | — |
| TCR 61 | — | — | 406 | — | — | — |
| TCR 62 | — | — | 407 | — | — | — |
| TCR 63 | — | — | 408 | — | — | — |
| TCR 64 | — | — | 409 | — | — | — |
| TCR 65 | — | — | 410 | — | — | — |

In some embodiments, the nucleic acid molecule may further encode a marker (e.g. EGFRt or other marker as described) that is separated from the CAR or separated from the TCR chains by a linker, such as a cleavable linker sequence or a peptide sequence that causes ribosome skipping, e.g., T2A or P2A.

In some embodiments, the construct can be arranged in any order so that the encoding marker sequence is either 3' to the alpha and/or beta sequence, 5' to the alpha and/or beta sequence and/or between the alpha and beta sequence, where, in some cases, each separate component is separated by a cleavable linker sequence or a peptide that causes ribosome skipping (e.g. T2A or P2A) or an IRES. In some embodiments, the nucleic acid molecule contains a nucleic acid sequence that encodes a marker (e.g., EGFRt), cleavable linker or ribosome skip sequence (e.g. T2A or P2A), beta chain, cleavable linker or ribosome skip sequence (e.g. T2A or P2A), and alpha chain, in that order. In some embodiments, the nucleic acid molecule contains a nucleic acid sequence that encodes a marker (e.g., EGFRt), cleavable linker or ribosome skip sequence (e.g., T2A or P2A), alpha chain, cleavable linker or ribosome skip sequence (e.g., T2A or P2A), and beta chain, in that order. In some embodiments, the nucleic acid molecule contains a nucleic acid sequence that encodes a beta chain, cleavable linker or ribosome skip sequence (e.g., T2A or P2A), an alpha chain, a cleavable linker or ribosome skip sequence (e.g., T2A or P2A) and a marker (e.g. EGFRt), in that order. In some embodiments, the nucleic acid molecule contains a nucleic acid sequence that encodes an alpha chain, cleavable linker or ribosome skip sequence (e.g. T2A or P2A), a beta chain, a cleavable linker or ribosome skip sequence (e.g., T2A or P2A) and a marker (e.g., EGFRt), in that order. In some embodiments, the nucleic acid molecule contains a nucleic acid sequence that encodes an alpha chain, cleavable linker or ribosome skip sequence (e.g., T2A or P2A), a marker (e.g., EGFRt), a cleavable linker or ribosome skip sequence (e.g., T2A or P2A) and a beta chain, in that order. In some embodiments, the nucleic acid molecule contains a nucleic acid sequence that encodes a beta chain, cleavable linker or ribosome skip sequence (e.g., T2A or P2A), a marker (e.g. EGFRt), a cleavable linker or ribosome skip sequence (e.g., T2A or P2A) and a alpha chain, in that order.

In some embodiments, introduction of a construct encoding the CAR and EGFRt separated by a T2A ribosome switch can express two proteins from the same construct, such that the EGFRt can be used as a marker to detect cells expressing such construct.

The nucleic acid may encode an amino acid sequence comprising the variable alpha (Va) region or variable light ($V_L$) region of the TCR or antibody, respectively. In some cases, the nucleic acid encodes an amino acid sequence comprising the variable beta (Vβ) region or variable heavy ($V_H$) region of the TCR or antibody, respectively. In a further embodiment, one or more vectors (e.g., expression vectors) comprising such nucleic acid are provided.

Also provided are vectors, such as those containing any of the nucleic acids described herein. In some embodiments, nucleic acid or nucleic acids encoding one or both chains of a binding molecule, e.g., TCR, are cloned into a suitable expression vector or vectors. The expression vector can be any suitable recombinant expression vector, and can be used to transform or transfect any suitable host. Suitable vectors include those designed for propagation and expansion or for expression or both, such as plasmids and viruses. In some embodiments, the vector is an expression vector.

In some embodiments, the vector can a vector of the pUC series (Fermentas Life Sciences), the pBluescript series (Stratagene, LaJolla, Calif.), the pET series (Novagen, Madison, Wis.), the pGEX series (Pharmacia Biotech, Uppsala, Sweden), or the pEX series (Clontech, Palo Alto, Calif.). In some cases, bacteriophage vectors, such as λG10, λGT11, λZapII (Stratagene), λEMBL4, and λNM1149, also can be used. In some embodiments, plant expression vectors can be used and include pBI01, pBI101.2, pBI101.3, pBI121 and pBIN19 (Clontech). In some embodiments, animal expression vectors include pEUK-C1, pMAM and pMAM-neo (Clontech). In some cases, the vector is a viral vector. In some such aspects, the viral vector is a retroviral vector, such as a lentiviral vector. In some instances, the lentiviral vector is derived from HIV-1.

In some embodiments, the recombinant expression vectors can be prepared using standard recombinant DNA techniques. In some embodiments, vectors can contain regulatory sequences, such as transcription and translation initiation and termination codons, which are specific to the type of host (e.g., bacterium, fungus, plant, or animal) into which the vector is to be introduced, as appropriate and taking into consideration whether the vector is DNA- or RNA-based. In some embodiments, the vector can contain a nonnative promoter operably linked to the nucleotide sequence encoding the binding molecule, such as TCR, antibody or antigen-binding fragment thereof. In some embodiments, the promoter can be a non-viral promoter or a viral promoter, such as a cytomegalovirus (CMV) promoter, an SV40 promoter, an RSV promoter, and a promoter found in the long-terminal repeat of the murine stem cell virus. Other promoters known to a skilled artisan also are contemplated.

Also provided are methods of making the binding molecules (including antigen-binding fragments). In some embodiments, a host cell comprising such nucleic acid is provided. For recombinant production of the binding molecules, nucleic acid encoding the binding molecule, e.g., as described above, may be isolated and inserted into one or more vectors for further cloning and/or expression in a host cell. Such nucleic acid may be readily isolated and sequenced using conventional procedures (e.g., by using oligonucleotide probes that are capable of binding specifically to genes encoding the alpha and beta chains of the TCR or the heavy and light chains of the antibody). In some embodiments, a method of making the binding molecule is provided, wherein the method comprises culturing a host cell comprising a nucleic acid encoding the binding molecule, as provided above, under conditions suitable for expression of the binding molecule, and optionally recovering the binding molecule from the host cell (or host cell culture medium).

In one such embodiment, a host cell comprises (e.g., has been transformed with): a vector comprising a nucleic acid that encodes an amino acid sequence comprising the Vβ region of the TCR or antigen-binding fragment thereof and a nucleic acid that encodes an amino acid sequence comprising the Vα region of the TCR or antigen-binding fragment thereof. In another such embodiment, a host cell comprises (e.g. has been transformed with): a vector comprising a nucleic acid that encodes an amino acid sequence comprising the VH of the antibody or antigen-binding fragment thereof and the VL of the antibody or antigen-binding fragment thereof. In some aspects, a host cell comprises (e.g., has been transformed with): a first vector comprising a nucleic acid that encodes an amino acid sequence comprising the Vα region of the TCR or antigen-binding fragment thereof and a second vector comprising a nucleic acid that encodes an amino acid sequence comprising the Vβ region of the TCR or antigen-binding fragment thereof. In other aspects, a host cell comprises (e.g. has been transformed with): a first vector comprising a nucleic acid that encodes an amino acid sequence or comprising the VL of the antibody or antigen-binding fragment thereof and a second vector comprising a nucleic acid that encodes an amino acid sequence comprising the VH of the antibody or antigen-binding fragment thereof.

In addition to prokaryotes, eukaryotic microbes such as filamentous fungi or yeast are suitable cloning or expression hosts for binding molecule-encoding vectors, including fungi and yeast strains whose glycosylation pathways have been modified to mimic or approximate those in human cells. See Gemgross, Nat. Biotech. 22:1409-1414 (2004), and Li et al., Nat. Biotech. 24:210-215 (2006).

Exemplary eukaryotic cells that may be used to express polypeptides include, but are not limited to, COS cells, including COS 7 cells; 293 cells, including 293-6E cells; CHO cells, including CHO-S, DG44, Lec13 CHO cells, and FUT8 CHO cells; PER.C6® cells; and NSO cells. In some embodiments, a particular eukaryotic host cell is selected based on its ability to make desired post-translational modifications to the binding molecule. For example, in some embodiments, CHO cells produce polypeptides that have a higher level of sialylation than the same polypeptide produced in 293 cells. In some embodiments, the binding molecule is produced in a cell-free system. Exemplary cell-free systems are described, e.g., in Sitaraman et al., *Methods Mol. Biol.* 498: 229-44 (2009); Spirin, *Trends Biotechnol.* 22: 538-45 (2004); Endo et al., *Biotechnol. Adv.* 21: 695-713 (2003).

3. Exemplary Features of Binding Molecules and Engineered Cells

In some aspects, the provided binding molecules, e.g. TCRs or TCR-like CAR have one or more specified functional features, such as binding properties, including binding to particular epitopes, lack of off-target binding or activity and/or particular binding affinities. In some embodiments, any one or more of the features of a provided TCR can be assessed by expressing the TCR, e.g., by introducing one or more nucleic acid encoding the TCR, into a T cell, such a primary T cell or a T cell line. In some embodiments, the T cell line is a Jurkat cell or a Jurkat-derived cell line. Exemplary of a Jurkat-derived cell line is the J.RT3-T3.5 (ATCC® TIB-153™) cell line, produced by treatment of the Jurkat leukemia cell line with irradiation mutagenesis and negative selection with OKT3 monoclonal antibody (see Weiss & Stobo, J. Ex. Med. 160(5):1284-1299 (1984)).

In some embodiments, the provided binding molecules are capable of binding to a peptide epitope of HPV16, e.g. an epitope of HPV 16 E6 or E7 such as described above, with at least a certain affinity, as measured by any of a number of known methods. In some embodiments, the peptide epitope is a peptide in the context of an MHC molecule or ligand. In some embodiments, the affinity is represented by an equilibrium dissociation constant ($K_D$) or an association constant ($k_a$). In some embodiments, the affinity is represented by $EC_{50}$.

In some embodiments, the binding molecule, e.g., TCR, binds, such as specifically binds, to a peptide epitope, e.g., in complex with an MHC molecule, with an affinity or $K_A$ (i.e., an equilibrium association constant of a particular binding interaction with units of 1/M; equal to the ratio of the on-rate [$k_{on}$ or $k_a$] to the off-rate [$k_{off}$ or $k_d$] for this association reaction, assuming bimolecular interaction) equal to or greater than $10^5$ $M^{-1}$. In some embodiments, the TCR or fragment thereof exhibits a binding affinity for the peptide epitope with a $K_D$ (i.e., an equilibrium dissociation constant of a particular binding interaction with units of M; equal to the ratio of the off-rate [$k_{off}$ or $k_d$] to the on-rate [$k_{on}$ or $k_a$] for this association reaction, assuming bimolecular interaction) of equal to or less than $10^{-5}$ M. For example, the equilibrium dissociation constant $K_D$ ranges from or from about $10^{-5}$ M to or to about $10^{-12}$ M, such as from or from about $10^{-6}$ M to or to about $10^{-10}$ M, from or from about $10^{-7}$ M to or to about $10^{-11}$ M, from or from about $10^{-6}$ M to or to about $10^{-8}$ M, or from or from about $10^{-7}$ M to or to about $10^{-8}$ M. The on-rate (association rate constant; $k_{on}$ or $k_a$; units of 1/Ms) and the off-rate (dissociation rate constant; $k_{off}$ or $k_d$; units of 1/s) can be determined using any of the assay methods known in the art, for example, surface plasmon resonance (SPR).

In some embodiments, binding affinity may be classified as high affinity or as low affinity. In some cases, the binding molecule (e.g. TCR) that exhibits low to moderate affinity binding exhibits a $K_A$ of up to $10^7$ M$^{-1}$, up to $10^6$ M$^{-1}$, up to $10^5$ M$^{-1}$. In some cases, a binding molecule (e.g. TCR) that exhibits high affinity binding to a particular epitope interacts with such epitope with a $K_A$ of at least $10^7$ M$^{-1}$, at least $10^8$ M$^{-1}$, at least $10^9$ M$^{-1}$, at least $10^{10}$ M$^{-1}$, at least $10^{11}$ M$^{-1}$, at least $10^{12}$ M$^{-1}$, or at least $10^{13}$ M$^{-1}$. In some embodiments, the binding affinity (EC$_{50}$) and/or the dissociation constant of the binding molecule to a peptide epitope of HPV 16 E6 or E7 is from or from about 0.1 nM to 1 µM, 1 nM to 1 µM, 1 nM to 500 nM, 1 nM to 100 nM, 1 nM to 50 nM, 1 nM to 10 nM, 10 nM to 500 nM, 10 nM to 100 nM, 10 nM to 50 nM, 50 nM to 500 nM, 50 nM to 100 nM or 100 nM to 500 nM. In certain embodiments, the binding affinity (EC$_{50}$) and/or the dissociation constant of the binding molecule to a peptide epitope of HPV 16 E6 or E7 is at or about or less than at or about 1 µM, 500 nm, 100 nM, 50 nM, 40 nM, 30 nM, 25 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, or 1 nM.

A variety of assays are known for assessing binding affinity and/or determining whether a binding molecule specifically binds to a particular ligand (e.g. peptide in the context of an MHC molecule). It is within the level of a skilled artisan to determine the binding affinity of a binding molecule, e.g., TCR, for a T cell epitope of a target polypeptide, such as by using any of a number of binding assays that are well known in the art. For example, in some embodiments, a BIAcore machine can be used to determine the binding constant of a complex between two proteins. The dissociation constant for the complex can be determined by monitoring changes in the refractive index with respect to time as buffer is passed over the chip. Other suitable assays for measuring the binding of one protein to another include, for example, immunoassays such as enzyme linked immunosorbent assays (ELISA) and radioimmunoassays (RIA), or determination of binding by monitoring the change in the spectroscopic or optical properties of the proteins through fluorescence, UV absorption, circular dichroism, or nuclear magnetic resonance (NMR). Other exemplary assays include, but are not limited to, Western blot, ELISA, analytical ultracentrifugation, spectroscopy and surface plasmon resonance (Biacore®) analysis (see, e.g., Scatchard et al., *Ann. N.Y. Acad. Sci.* 51:660, 1949; Wilson, *Science* 295:2103, 2002; Wolff et al., *Cancer Res.* 53:2560, 1993; and U.S. Pat. Nos. 5,283,173, 5,468,614, or the equivalent), flow cytometry, sequencing and other methods for detection of expressed nucleic acids. In one example, apparent affinity for a TCR is measured by assessing binding to various concentrations of tetramers, for example, by flow cytometry using labeled tetramers. In one example, apparent $K_D$ of a TCR is measured using 2-fold dilutions of labeled tetramers at a range of concentrations, followed by determination of binding curves by non-linear regression, apparent $K_D$ being determined as the concentration of ligand that yielded half-maximal binding.

In some embodiments, the binding molecules display a binding preference for antigen recognition of HPV 16 E6- or E7-expressing cells as compared to HPV 16 E6- or E7-negative cells, such as particular cells known and/or described herein to express HPV 16 E6 or E7 and known not to express HPV 16 E6 or E7. In some embodiments, the binding preference is observed where a significantly greater degree of binding is measured to the HPV 16 E6- or E7-expressing, as compared to the non-HPV 16 E6- or E7-expressing cells. In some embodiments, the fold change in degree of binding detected, for example, as measured by mean fluorescence intensity in a flow cytometry-based assay and/or dissociation constant or EC$_{50}$, to the HPV 16 E6- or E7-expressing cells as compared to the non-HPV 16 E6- or E7-expressing cells, is at least at or about 1.5, 2, 3, 4, 5, 6, or more.

In some embodiments, the binding molecule, e.g. TCR, does not exhibit cross-reactive or off-target binding, such as undesirable off-target binding, e.g. off-target binding to antigens present in healthy or normal tissues or cells. In some embodiments, the binding molecule, e.g. TCR, recognizes, such as specifically binds, only one peptide epitope or antigen complex, such as recognizes only a particular HPV 16 E6 epitope set forth in SEQ ID NO:268 or E7 epitope set forth in any of SEQ ID NO: 271 or an antigen complex thereof. Thus, in some embodiments, the provided binding molecules, e.g. TCRs, have a reduced risk of causing unwanted side effects due to, for example, recognition of a non-target peptide epitope.

In some embodiments, the binding molecule, e.g., TCR, does not recognize, such as does not specifically bind, a sequence-related peptide epitope of the HPV 16 E6 epitope set forth in SEQ ID NO:268 or E7 epitope set forth in SEQ ID NO: 271, i.e., does not recognize an epitope sharing some amino acids in common with an HPV 16 E6 or E7 epitope set forth in any of SEQ ID NO: 268 or 271, respectively, such as does not recognize an epitope that differs in 1, 2, 3, 4, 5 or 6 amino acid residues from such epitope when the epitopes are aligned. In some embodiments, the binding molecule, e.g., TCR, does not recognize a sequence-unrelated epitope of the HPV 16 E6 set forth in SEQ ID NO:268 or E7 epitope set forth in SEQ ID NO: 271, i.e., does not recognize an epitope that is substantially different in sequence compared to an HPV 16 E6 or E7 epitope set forth in SEQ ID NO: 268 or 271, respectively, such as differing in more than 6, 7, 8, 9, 10 or more amino acid residues from such epitope when the epitopes are aligned. In some embodiments, the binding molecule, e.g., TCR, does not recognize the HPV 16 E6 epitope set forth in SEQ ID NO:268 or E7 epitope set forth in SEQ ID NO:271 in the context of a different MHC allele, such as in the context of an MHC allele other than HLA-A2.

Typically, specific binding of binding molecule, e.g. TCR, to a peptide epitope, e.g. in complex with an MHC, is governed by the presence of an antigen-binding site containing one or more complementarity determining regions (CDRs). In general, it is understood that specifically binds does not mean that the particular peptide epitope, e.g. in complex with an MHC, is the only thing to which the MHC-peptide molecule may bind, since non-specific binding interactions with other molecules may also occur. In some embodiments, binding of binding molecule to a peptide in the context of an MHC molecule is with a higher affinity than binding to such other molecules, e.g. another peptide in the context of an MHC molecule or an irrelevant (control) peptide in the context of an MHC molecule, such as at least about 2-fold, at least about 10-fold, at least about 20-fold, at least about 50-fold, or at least about 100-fold higher than binding affinity to such other molecules.

In some embodiments, the provided binding molecules, e.g., TCRs, are capable of binding to or recognizing, such as specifically binding to or recognizing, an antigen that is associated with, specific to, and/or expressed on a cell or tissue of a disease, disorder or condition, such as a cancer or a tumor. In some aspects, the antigen is in a form of a peptide, e.g., is a peptide antigen or a peptide epitope. In some embodiments, the provided TCRs bind to, such as specifically bind to, an antigen that is a peptide, in the context of a major histocompatibility (MHC) molecule.

The observation that binding molecule binds to an antigen, e.g., peptide antigen, or specifically binds to an antigen, e.g., peptide antigen, does not necessarily mean that it binds to an antigen of every species. For example, in some embodiments, features of binding to the antigen, e.g., peptide antigen in the context of an MHC, such as the ability to specifically bind thereto and/or to compete for binding thereto with a reference binding molecule or a receptor, and/or to bind with a particular affinity or compete to a particular degree, in some embodiments, refers to the ability with respect to a human antigen and the binding molecule may not have this feature with respect to the antigen from another species, such as mouse. In some aspects, the extent of binding of the binding molecule or an antigen-binding fragment thereof to an unrelated antigen or protein, such as an unrelated peptide antigen, is less than at or about 10% of the binding of the binding molecule or an antigen-binding fragment thereof to the antigen, e.g., cognate antigen as measured, e.g., by a radioimmunoassay (RIA), a peptide titration assay or a reporter assay.

In some embodiments, the binding molecule, e.g., TCR, can be assessed for safety or off-target binding activity using any of a number of screening assays known in the art. In some embodiments, generation of an immune response to a particular binding molecule, e.g., TCR, can be measured in the presence of cells that are known not to express the target peptide epitope, such as cells derived from normal tissue(s), allogenic cell lines that express one or more different MHC types or other tissue or cell sources. In some embodiments, the cells or tissues include normal cells or tissues. For example, in some cases, cells or tissues can include brain, muscle, liver, colon, kidney, lung, ovary, placenta, heart, pancreas, prostate, epithelium or skin, testis, adrenal, intestine, bone marrow or spleen. In some embodiments, the binding to cells can be tested in 2 dimensional cultures. In some embodiments, the binding to cells can be tested in 3 dimensional cultures. In some embodiments, as a control, the tissues or cells can be ones that are known to express the target epitope. The immune response can be assessed directly or indirectly, such as by assessing activation of immune cells such as T cells (e.g. cytotoxic activity), production of cytokine (e.g. interferon gamma), or activation of a signaling cascade, such as by reporter assays.

In some embodiments, potential off-targets can be identified by performing a homology scan of the human genome using the particular target epitope, e.g., to identify potential sequence-related epitopes. In some cases, a protein sequence database can be analyzed to identify peptides with similarity to the target peptide epitope. In some embodiments, to facilitate identification of potential sequence-related epitopes of interest, a binding motif can first be identified. In some embodiments, the binding motif can be identified by peptide scanning, such as an alanine mutagenesis scan, of the target epitope (e.g., HPV 16 E6 or E7 epitope set forth in SEQ ID NO: 268 or 271) to identify the binding motif recognized by the binding molecule, see e.g. WO2014/096803. In some embodiments, the binding motif can be identified by mutagenesis of the target peptide so that a series of mutants are generated in which each amino acid or a subset thereof is changed to another amino acid residue, tested for its activity relative to the original target epitope, and those residues that are involved in or required for binding are identified. In some embodiments, a series of mutants may be made in which the amino acid residue at each position of the target epitope is mutated to all alternative amino acids. In some cases, once the binding motif is identified (i.e. amino acid residues that are non-tolerated and are involved in or are required for binding), protein databases may be searched for proteins that contain the binding motif.

In some embodiments, suitable protein databases include but are not limited to UniProtKB/Swiss-Prot (http://www.uniprot.org/), Protein Information Resource (PI R) (http://pir.georgetown.edu/pirwww/index.shtml), and/or Reference Sequence (RefSeq) (www.ncbi.nlm.nih.gov/RefSeq). Searching for a peptide motif may be carried out using any one of a number of tools, which may be found on bioinformatics resource sites such as ExPASY (http://www-.expasy.org/). For example, the search tool ScanProsite identifies user-defined motifs in all protein sequences in the UniProtKB/Swiss-Prot Protein Knowledgebase (De Castro et al. Nucleic Acids Res. 2006 Jul. 1; 34 (Web Server issue):W362-5). In some cases, the search may be carried out for peptides that are of human origin or of organisms which are commonly present in humans, such as viral or bacterial pathogens, or commensal bacteria.

In some embodiments, if a potential off-target epitope is identified, the binding molecule, e.g., TCR, can be redesigned so that there is no longer any cross reactivity to the off target peptide(s), while maintaining binding, preferably with high affinity, to the target peptide epitope. For example, T cell receptors can be redesigned by mutagenesis using the methods described in WO 03/020763.

In some embodiments, the binding molecules, e.g., engineered cells comprising the binding molecules, e.g., TCRs, elicit an immune response to HPV 16. In some embodiments, cytotoxic T lymphocytes (CTL) may be activated when cells containing the binding molecules, e.g., TCRs, are contacted with target cells, such as cancer cells, those that are infected with HPV or contain HPV DNA sequences and/or those that express HPV 16, such as HPV 16 E6 or HPV 16 E7. For example, cells containing the TCRs exhibit cytotoxic activity if they induce lysis of target cells, such as cancer cells or cells known to express HPV or contain HPV DNA sequences, including HPV 16-expressing cells, e.g., HPV 16 E6- or E7-expressing cells. In some cases, cytotoxic activity can be assessed by incubation or contact of the exemplary cell line SCC152 with T cells expressing provided binding molecules, such as any of the provided TCRs or antigen-binding fragments thereof.

In certain embodiments, the ability of the engineered cells to destroy target cells can be measured using any suitable method known in the art, such as cytotoxicity assays or CTL activation, such as described in, for example, Kochenderfer et al., J. Immunotherapy, 32(7): 689-702 (2009), and Herman et al. J. Immunological Methods, 285(1): 25-40 (2004). A variety of techniques exist for assaying the activity of CTL. In some embodiments, CTL activity can be assessed by assaying the culture for the presence of CTLs that lyse radio-labeled target cells, such as specific peptide-pulsed targets. These techniques include the labeling of target cells with radionuclides such as $Na_2$, $^{51}CrO_4$ or $^3$H-thymidine, and measuring the release or retention of the radionuclides from the target cells as an index of cell death. In some embodiments, CTL are known to release a variety of cytokines when they are stimulated by an appropriate target cell, such as a tumor cell expressing the relevant MHC molecule and the corresponding peptide epitope, and the presence of such epitope-specific CTLs can be determined by measuring cytokine release. Non-limiting examples of such cytokines include IFN-γ, TNF-α, and GM-CSF. Assays for these cytokines are well known in the art, and their selection is left to the skilled artisan. Methodology for measuring both target cell death and cytokine release as a measure of CTL reactivity are given in Coligan, J. E. et al. (Current Protocols in Immunology, 1999, John Wiley & Sons, Inc., New York).

In some aspects, the ability of the binding molecules, such as cells expressing the binding molecules, e.g., TCRs or CARs, to elicit an immune response can be determined by measuring cytokine release. In some embodiments, in response to co-culture with or exposure to cells expressing the binding molecules, e.g., TCRs or CARs, a variety of cytokines are released when the cells are stimulated by an appropriate target cell known to express HPV 16, such as HPV 16 E6 or HPV 16 E7. Non-limiting examples of such cytokines include IFN-γ, TNF-α, and GM-CSF. In some embodiments, cytokine production can be measured as an indicator of an immune response. In some cases, such measured cytokines can include, without limitation, interleukin-2 (IL-2), interferon-gamma (IFNγ), interleukin-4 (IL-4), TNF-alpha, interleukin-6 (IL-6), interleukin-10 (IL-10), interleukin-12 (IL-12) or TGF-beta. Assays to measure cytokines are well known in the art, and include, without limitation, ELISA, intracellular cytokine staining, cytometric bead array, RT-PCR, ELISPOT, flow cytometry and bio-assays in which cells responsive to the relevant cytokine are tested for responsiveness (e.g. proliferation) in the presence of a test sample.

Exemplary cells known to express HPV 16 include, but are not limited to, CaSki cells (ATCC No. CRL-1550, which contain about 600 copies of integrated HPV16), SCC152 or other tumor cell expressing the relevant MHC molecule and the corresponding peptide epitope, e.g., HPV 16 E6 or E7 epitope, such as any of those set forth in SEQ ID NO: 268 or 271.

In some embodiments, cells exposed to the binding molecules, e.g. cells containing the binding molecules, such as TCRs or CARs, are assessed for an immunological readout, such as using a T cell assay. In some embodiments, the binding molecule-containing cells can activate a CD8+ T cell response. In one embodiment, CD8+ T cell responses can be assessed by monitoring CTL reactivity using assays that include, but are not limited to, target cell lysis via $^{51}$Cr release or detection of interferon gamma release, such as by enzyme-linked immunosorbent spot assay (ELISA), intracellular cytokine staining or ELISPOT. In some embodiments, the binding molecules, e.g., cells containing the binding molecules, such as TCRs or CARs, can activate a CD4+ T cell response. In some aspects, CD4+ T cell responses can be assessed by assays that measure proliferation, such as by incorporation of [3H]-thymidine into cellular DNA and/or by the production of cytokines, such as by ELISA, intracellular cytokine staining or ELISPOT. In some cases, the cytokine can include, for example, interleukin-2 (IL-2), interferon-gamma (IFN-gamma), interleukin-4 (IL-4), TNF-alpha, interleukin-6 (IL-6), interleukin-10 (IL-10), interleukin-12 (IL-12) or TGF beta. In some embodiments, recognition or binding of the peptide epitope, such as a MHC class II epitope, by the binding molecule can elicit or activate a CD4+ T cell response and/or a CD8+ T cell response.

In some embodiments, the binding specificity and/or function (e.g., ability to elicit an immune response to HPV 16) of the binding molecule, e.g., TCR or antigen-binding fragment thereof, is at least partially CD8-independent. In some cases, TCR recognition of a peptide in the context of an MHC molecule and subsequent T cell activation is facilitated in the presence of a CD8 co-receptor. For example, CD8 co-receptor engagement can facilitate low- to moderate-TCR affinity interactions and/or T cell activation (See, for example, Kerry et al. J. Immunology (2003) 171(9): 4493-4503 and Robbins et al. J Immunology (2008) 180(9): 6116-6131). Among the provided binding molecules are molecules, e.g. TCRs, that exhibit CD8-independent binding for an HPV E6 or E7 peptide epitope. Exemplary of such a TCR is a TCR designated TCR 57 as described herein or a TCR containing CDRs of a TCR designated TCR 57 and/or a Vα or Vβ chain of such TCR, see e.g. Tables 5, 6 and 7. In some embodiments, such binding molecules, e.g. TCR, may have higher functional avidity or affinity than TCRs or antigen binding fragments thereof that require the presence of CD8 co-expression. In some aspects, the provided CD8-independent binding molecules, such as TCRs, can be expressed or engineered in cells, e.g. T cells, that do not express CD8, such as can be expressed or engineered in CD4+ cells. In some embodiments, among the provided engineered non-CD8-expressing cells, e.g. CD4+ cells, are cells expressing a recombinant binding molecule, e.g., TCR or antigen-binding fragment, that exhibit at least or at least about 20%, 30%, 40%, 50%, 60%, 70%, 80%, 90% or more of the binding specificity, affinity and/or avidity for a peptide in the context of an MHC molecule as the same binding molecule (e.g., TCR or antigen-binding fragment thereof) that is expressed on a CD8+ T cell.

III. METHODS FOR IDENTIFYING AND GENERATING T CELL RECEPTORS

In some embodiments, provided are methods for identifying and generating T cell receptors directed towards a target antigen. In some aspects, the methods involve subjecting biological samples containing T cells, such as primary T cells, including those derived from normal donors or patients having a disease or condition of interest, to multiple rounds of antigen exposure and assessment. In some aspects, the rounds involve the use of artificial or engineered antigen presenting cells, such as autologous dendritic cells or other APCs pulsed with a desired peptide antigen, to promote presentation on an MHC, such as a class I or II MHC. In some aspects, multiple rounds of antigen exposure are carried out and in some aspects T cells are sorted following one or more of the rounds, e.g., based on ability to bind to the desired antigen (such as peptide-MHC tetramers). In some aspects sorting is carried out by flow cytometry. In some aspects, cells from cells deemed to bind to the desired antigen (positive fraction) and cells deemed not to bind to the antigen, are assessed, e.g., by single-cell sequencing methods. In some aspects, the methods sequence and identify, at a single-cell level, TCR pairs present in each sample. In some aspects, the methods can quantify the number of copies of a given TCR pair present in a sample, and as such can assess the abundance of a given TCR in a given sample, and/or enrichment thereof over another sample, such as enrichment or abundance in the positive (antigen-binding) fraction, e.g., over one or more rounds, for example, as compared to the negative fraction. In some aspects, such assays are performed to generate antigen-specific T cell receptors (TCRs) that specifically bind to human papillomavirus 16 or 18 peptide antigens such as peptides derived from E6 or E7, such as E6(29-38) or E7(11-19) peptide, e.g., presented on MHC-I molecules and survived and/or were enriched over time, following multiple rounds of antigen-stimulation. In some aspects, clonal T cell lines are generated and the sequences of individual paired TCR alpha and beta chains and abundance thereof in various populations were determined on a single-cell basis, using high-throughput paired TCR sequencing.

In some aspects, peptide-pulsed HLA:A02:01APCs were generated with HPV 16 E6(29-38) peptide (TIHDIILECV; SEQ ID NO:268) or E7(11-19) peptide (YMLDLQPET; SEQ ID NO:271). Autologous CD8+ T cells from normal human donors are incubated over multiple rounds with the peptide-pulsed cells, and selections were carried out based on binding to peptide-loaded autologous MHC tetramers.

In some aspects, cells were subjected to multiple, such as a total of two or three or more, rounds of stimulation, in the presence of peptide-pulsed cells (such as with a particular peptide concentration of 1000 ng/mL maintained over the three rounds). Following one or more of, such as following the first and/or following the second and third rounds of stimulation, cells were sorted by flow cytometry into populations positive and negative, respectively, for binding to peptide-MHC tetramers containing the appropriate tetramer. Cells of the tetramer-positive and negative populations following each or one or more of the one or more, such as the second and third, rounds in some aspects are subjected to single-cell TCR sequencing, to assess the presence and frequency of individual TCRs in the different populations, and the persistence of TCR clones over multiple rounds of antigen stimulation.

In some aspects, cell populations from the positive and negative fractions (i.e., sorted by flow cytometry based on positive and negative staining, respectively, for binding to the relevant antigen such as peptide-MHC such as loaded tetramers, e.g., as determined by flow cytometry), following the one or more rounds, are subject to high-throughput single-cell sequencing for TCR alpha and beta chain pairs. High throughput single cell TCR sequencing in some aspects is performed as generally described in published PCT patent applications, publication numbers WO2012/048340, WO2012/048341 and WO2016/044227. The sequencing methods thus in some aspects employ single-cell droplets and sample and molecular barcodes, to identify individual pairs of TCR alpha and beta chain sequences at a single-cell level, for each of a large number (e.g., millions) of single cells present in a single starting composition, and to assess abundance of each TCR pair in various populations assessed. The ability to identify and quantify TCR pairs at a single-cell level in some embodiments permits the assessment of the frequency of each of various TCR pairs in each of the individual positive and negative fractions, and to assess enrichment and persistence of TCRs over multiple rounds of antigen stimulation.

In some aspects, the methods generate, identify, isolate and/or select TCR pairs that are enriched in antigen-binding, e.g., peptide-binding, fractions following at least one and in some aspects a plurality of, multiple rounds of stimulation. In some aspects, the TCRs are present in and/or present at a desired abundance in and/or preferentially enriched following, rounds 1, 2 and/or and 3 and in some aspects at least multiple rounds, of antigen exposure. In some aspects, the TCRs are enriched in the population over time following multiple rounds of exposure to antigen. Also provided are TCRs generated or identified using such methods, such as TCRs having such properties, such as the ability to survive and/or expand over multiple rounds of antigen exposure, such as in a peptide-pulsed APC assay.

IV. ENGINEERED CELLS

Also provided are cells such as cells that have been engineered to contain the binding molecule described herein. Also provided are populations of such cells, compositions containing such cells and/or enriched for such cells, such as in which cells expressing the binding molecule make up at least 15%, 20%, 25%, 30%, 35%, 40%, 50%, 60%, 70%, 80%, 90%, 91%, 92%, 93%, 94%, 95%, 96%, 97%, 98%, 99%, or more percent of the total cells in the composition or cells of a certain type such as T cells or CD8+ or CD4+ cells. In some embodiments, the cells are primary T cells. Among the compositions are pharmaceutical compositions and formulations for administration, such as for adoptive cell therapy. Also provided are therapeutic methods for administering the cells and compositions to subjects, e.g., patients.

Thus also provided are genetically engineered cells expressing the binding molecules. The cells generally are eukaryotic cells, such as mammalian cells, and typically are human cells. In some embodiments, the cells are derived from the blood, bone marrow, lymph, or lymphoid organs, are cells of the immune system, such as cells of the innate or adaptive immunity, e.g., myeloid or lymphoid cells, including lymphocytes, typically T cells and/or NK cells. Other exemplary cells include stem cells, such as multipotent and pluripotent stem cells, including induced pluripotent stem cells (iPSCs). The cells typically are primary cells, such as those isolated directly from a subject and/or isolated from a subject and frozen. In some embodiments, the cells include one or more subsets of T cells or other cell types, such as whole T cell populations, CD4+ cells, CD8+ cells, and subpopulations thereof, such as those defined by function, activation state, maturity, potential for differentiation, expansion, recirculation, localization, and/or persistence capacities, antigen-specificity, type of antigen receptor, presence in a particular organ or compartment, marker or cytokine secretion profile, and/or degree of differentiation. With reference to the subject to be treated, the cells may be allogeneic and/or autologous. Among the methods include off-the-shelf methods. In some aspects, such as for off-the-shelf technologies, the cells are pluripotent and/or multipotent, such as stem cells, such as induced pluripotent stem cells (iPSCs). In some embodiments, the methods include isolating cells from the subject, preparing, processing, culturing, and/or engineering them, as described herein, and re-introducing them into the same patient, before or after cryopreservation.

Among the sub-types and subpopulations of T cells and/or of CD4+ and/or of CD8+ T cells are naïve T ($T_N$) cells, effector T cells ($T_{EFF}$), memory T cells and sub-types thereof, such as stem cell memory T ($T_{SCM}$), central memory T ($T_{CM}$), effector memory T ($T_{EM}$), or terminally differentiated effector memory T cells, tumor-infiltrating lymphocytes (TIL), immature T cells, mature T cells, helper T cells, cytotoxic T cells, mucosa-associated invariant T (MAIT) cells, naturally occurring and adaptive regulatory T (Treg) cells, helper T cells, such as TH1 cells, TH2 cells, TH3 cells, TH17 cells, TH9 cells, TH22 cells, follicular helper T cells, alpha/beta T cells, and delta/gamma T cells.

In some embodiments, the cells are natural killer (NK) cells. In some embodiments, the cells are monocytes or granulocytes, e.g., myeloid cells, macrophages, neutrophils, dendritic cells, mast cells, eosinophils, and/or basophils.

In some embodiments, the cells include one or more nucleic acids introduced via genetic engineering, and thereby express recombinant or genetically engineered products of such nucleic acids. In some embodiments, the nucleic acids are heterologous, i.e., normally not present in a cell or sample obtained from the cell, such as one obtained from another organism or cell, which for example, is not ordinarily found in the cell being engineered and/or an organism from which such cell is derived. In some embodiments, the nucleic acids are not naturally occurring, such as a nucleic acid not found in nature, including one comprising chimeric combinations of nucleic acids encoding various domains from multiple different cell types.

In some embodiments, genes and/or gene products (and/or expression thereof) in the provided cells, and/or compositions containing such cells, are reduced, deleted, eliminated, knocked-out or disrupted. Such genes and/or gene products in some aspects include one or more of the gene encoding (or product thereof) TCR alpha (TRAC) and/or TCR beta (TRBC), e.g., to reduce or prevent expression of the endogenous TCR in the cell, e.g. T cell, and/or α chain thereof. In some embodiments, reducing or preventing endogenous TCR expression can lead to a reduced risk or chance of mispairing between chains of the engineered TCR and the endogenous TCR, thereby creating a new TCR that could potentially result in a higher risk of undesired or unintended antigen recognition and/or side effects, and/or could reduce expression levels of the desired exogenous TCR. In some aspects, reducing or preventing endogenous TCR expression can increase expression of the engineered TCR in the cells as compared to cells in which expression of the TCR is not reduced or prevented, such as increased by 1.5-fold, 2-fold, 3-fold, 4-fold, 5-fold or more. For example, in some cases, suboptimal expression of an engineered or recombinant TCR can occur due to competition with an endogenous TCR and/or with TCRs having mispaired chains, for the invariant CD3 signaling molecules that are involved in permitting expression of the complex on the cell surface. In some embodiments, reduction, deletion, elimination, knockout or disruption is carried out by gene editing, such as using a zinc finger nuclease (ZFN), TALEN or a CRISPR/Cas system with an engineered single guide RNA (gRNA) that cleaves a TCR gene. In some embodiments, reducing expression of an endogenous TCR is carried out using an inhibitory nucleic acid molecule against a target nucleic acids encoding specific TCRs (e.g., TCR-α and TCR-β). In some embodiments, the inhibitory nucleic acid is or contains or encodes a small interfering RNA (siRNA), a microRNA-adapted shRNA, a short hairpin RNA (shRNA), a hairpin siRNA, a microRNA (miRNA-precursor) or a microRNA (miRNA). Exemplary methods for reducing or preventing endogenous TCR expression are known in the art, see e.g. U.S. Pat. No. 9,273,283; U.S. publication no. US2014/0301990; and PCT publication No. WO2015/161276.

A. Preparation of Cells for Genetic Engineering

In some embodiments, preparation of the engineered cells includes one or more culture and/or preparation steps. The cells for introduction of the binding molecule, e.g., TCR or CAR, may be isolated from a sample, such as a biological sample, e.g., one obtained from or derived from a subject. In some embodiments, the subject from which the cell is isolated is one having the disease or condition or in need of a cell therapy or to which cell therapy will be administered. The subject in some embodiments is a human in need of a particular therapeutic intervention, such as the adoptive cell therapy for which cells are being isolated, processed, and/or engineered.

Accordingly, the cells in some embodiments are primary cells, e.g., primary human cells. The samples include tissue, fluid, and other samples taken directly from the subject, as well as samples resulting from one or more processing steps, such as separation, centrifugation, genetic engineering (e.g. transduction with viral vector), washing, and/or incubation. The biological sample can be a sample obtained directly from a biological source or a sample that is processed. Biological samples include, but are not limited to, body fluids, such as blood, plasma, serum, cerebrospinal fluid, synovial fluid, urine and sweat, tissue and organ samples, including processed samples derived therefrom.

In some aspects, the sample from which the cells are derived or isolated is blood or a blood-derived sample, or is or is derived from an apheresis or leukapheresis product. Exemplary samples include whole blood, peripheral blood mononuclear cells (PBMCs), leukocytes, bone marrow, thymus, tissue biopsy, tumor, leukemia, lymphoma, lymph node, gut associated lymphoid tissue, mucosa associated lymphoid tissue, spleen, other lymphoid tissues, liver, lung, stomach, intestine, colon, kidney, pancreas, breast, bone, prostate, cervix, testes, ovaries, tonsil, or other organ, and/or cells derived therefrom. Samples include, in the context of cell therapy, e.g., adoptive cell therapy, samples from autologous and allogeneic sources.

In some embodiments, the cells are derived from cell lines, e.g., T cell lines. The cells in some embodiments are obtained from a xenogeneic source, for example, from mouse, rat, non-human primate, or pig.

In some embodiments, isolation of the cells includes one or more preparation and/or non-affinity based cell separation steps. In some examples, cells are washed, centrifuged, and/or incubated in the presence of one or more reagents, for example, to remove unwanted components, enrich for desired components, lyse or remove cells sensitive to particular reagents. In some examples, cells are separated based on one or more property, such as density, adherent properties, size, sensitivity and/or resistance to particular components.

In some examples, cells from the circulating blood of a subject are obtained, e.g., by apheresis or leukapheresis. The samples, in some aspects, contain lymphocytes, including T cells, monocytes, granulocytes, B cells, other nucleated white blood cells, red blood cells, and/or platelets, and in some aspects contains cells other than red blood cells and platelets.

In some embodiments, the blood cells collected from the subject are washed, e.g., to remove the plasma fraction and to place the cells in an appropriate buffer or media for subsequent processing steps. In some embodiments, the cells are washed with phosphate buffered saline (PBS). In some embodiments, the wash solution lacks calcium and/or magnesium and/or many or all divalent cations. In some aspects, a washing step is accomplished a semi-automated "flow-through" centrifuge (for example, the Cobe 2991 cell processor, Baxter) according to the manufacturer's instructions. In some aspects, a washing step is accomplished by tangential flow filtration (TFF) according to the manufacturer's instructions. In some embodiments, the cells are resuspended in a variety of biocompatible buffers after washing, such as, for example, $Ca^{++}/Mg^{++}$ free PBS. In certain embodiments, components of a blood cell sample are removed and the cells directly resuspended in culture media.

In some embodiments, the methods include density-based cell separation methods, such as the preparation of white blood cells from peripheral blood by lysing the red blood cells and centrifugation through a Percoll or Ficoll gradient.

In some embodiments, the isolation methods include the separation of different cell types based on the expression or presence in the cell of one or more specific molecules, such as surface markers, e.g., surface proteins, intracellular markers, or nucleic acid. In some embodiments, any known method for separation based on such markers may be used. In some embodiments, the separation is affinity- or immunoaffinity-based separation. For example, the isolation in some aspects includes separation of cells and cell populations based on the cells' expression or expression level of one or more markers, typically cell surface markers, for example, by incubation with an antibody or binding partner that specifically binds to such markers, followed generally by washing steps and separation of cells having bound the antibody or binding partner, from those cells having not bound to the antibody or binding partner.

Such separation steps can be based on positive selection, in which the cells having bound the reagents are retained for further use, and/or negative selection, in which the cells having not bound to the antibody or binding partner are retained. In some examples, both fractions are retained for further use. In some aspects, negative selection can be particularly useful where no antibody is available that specifically identifies a cell type in a heterogeneous population, such that separation is best carried out based on markers expressed by cells other than the desired population.

The separation need not result in 100% enrichment or removal of a particular cell population or cells expressing a particular marker. For example, positive selection of or enrichment for cells of a particular type, such as those expressing a marker, refers to increasing the number or percentage of such cells, but need not result in a complete absence of cells not expressing the marker. Likewise, negative selection, removal, or depletion of cells of a particular type, such as those expressing a marker, refers to decreasing the number or percentage of such cells, but need not result in a complete removal of all such cells.

In some examples, multiple rounds of separation steps are carried out, where the positively or negatively selected fraction from one step is subjected to another separation step, such as a subsequent positive or negative selection. In some examples, a single separation step can deplete cells expressing multiple markers simultaneously, such as by incubating cells with a plurality of antibodies or binding partners, each specific for a marker targeted for negative selection. Likewise, multiple cell types can simultaneously be positively selected by incubating cells with a plurality of antibodies or binding partners expressed on the various cell types.

For example, in some aspects, specific subpopulations of T cells, such as cells positive or expressing high levels of one or more surface markers, e.g., $CD28^+$, $CD62L^+$, $CCR7^+$, $CD27^+$, $CD127^+$, $CD4^+$, $CD8^+$, $CD45RA^+$, and/or $CD45RO^+$ T cells, are isolated by positive or negative selection techniques.

For example, $CD3^+$, $CD28^+$ T cells can be positively selected using anti-CD3/anti-CD28 conjugated magnetic beads (e.g., DYNABEADS® M-450 CD3/CD28 T Cell Expander).

In some embodiments, isolation is carried out by enrichment for a particular cell population by positive selection, or depletion of a particular cell population, by negative selection. In some embodiments, positive or negative selection is accomplished by incubating cells with one or more antibodies or other binding agent that specifically bind to one or more surface markers expressed or expressed ($marker^+$) at a relatively higher level ($marker^{high}$) on the positively or negatively selected cells, respectively.

In some embodiments, T cells are separated from a PBMC sample by negative selection of markers expressed on non-T cells, such as B cells, monocytes, or other white blood cells, such as CD14. In some aspects, a $CD4^+$ or $CD8^+$ selection step is used to separate $CD4^+$ helper and $CD8^+$ cytotoxic T cells. Such $CD4^+$ and $CD8^+$ populations can be further sorted into sub-populations by positive or negative selection for markers expressed or expressed to a relatively higher degree on one or more naive, memory, and/or effector T cell subpopulations.

In some embodiments, $CD8^+$ cells are further enriched for or depleted of naive, central memory, effector memory, and/or central memory stem cells, such as by positive or negative selection based on surface antigens associated with the respective subpopulation. In some embodiments, enrichment for central memory T ($T_{CM}$) cells is carried out to increase efficacy, such as to improve long-term survival, expansion, and/or engraftment following administration, which in some aspects is particularly robust in such sub-populations. See Terakura et al. (2012) Blood. 1:72-82; Wang et al. (2012) J Immunother. 35(9):689-701. In some embodiments, combining $T_{CM}$-enriched $CD8^+$ T cells and CD4+ T cells further enhances efficacy.

In embodiments, memory T cells are present in both $CD62L^+$ and $CD62L^-$ subsets of $CD8^+$ peripheral blood lymphocytes. PBMC can be enriched for or depleted of $CD62L$-$CD8^+$ and/or $CD62L$+$CD8^+$ fractions, such as using anti-CD8 and anti-CD62L antibodies.

In some embodiments, the enrichment for central memory T ($T_{CM}$) cells is based on positive or high surface expression of CD45RO, CD62L, CCR7, CD28, CD3, and/or CD 127; in some aspects, it is based on negative selection for cells expressing or highly expressing CD45RA and/or granzyme B. In some aspects, isolation of a $CD8^+$ population enriched for $T_{CM}$ cells is carried out by depletion of cells expressing CD4, CD14, CD45RA, and positive selection or enrichment for cells expressing CD62L. In one aspect, enrichment for central memory T ($T_{CM}$) cells is carried out starting with a negative fraction of cells selected based on CD4 expression, which is subjected to a negative selection based on expression of CD14 and CD45RA, and a positive selection based on CD62L. Such selections in some aspects are carried out simultaneously and in other aspects are carried out sequentially, in either order. In some aspects, the same CD4 expression-based selection step used in preparing the $CD8^+$ cell population or subpopulation, also is used to generate the $CD4^+$ cell population or subpopulation, such that both the positive and negative fractions from the CD4-based separation are retained and used in subsequent steps of the methods, optionally following one or more further positive or negative selection steps.

In a particular example, a sample of PBMCs or other white blood cell sample is subjected to selection of $CD4^+$ cells, where both the negative and positive fractions are retained. The negative fraction then is subjected to negative selection based on expression of CD14 and CD45RA, and positive selection based on a marker characteristic of central memory T cells, such as CD62L or CCR7, where the positive and negative selections are carried out in either order.

$CD4^+$ T helper cells are sorted into naïve, central memory, and effector cells by identifying cell populations that have cell surface antigens. CD4+ lymphocytes can be obtained by standard methods. In some embodiments, naive CD4+ T lymphocytes are CD45RO−, CD45RA+, CD62L+, CD4+ T cells. In some embodiments, central memory CD4+ cells are CD62L+ and CD45RO+. In some embodiments, effector CD4+ cells are CD62L− and CD45RO−.

In one example, to enrich for CD4+ cells by negative selection, a monoclonal antibody cocktail typically includes antibodies to CD14, CD20, CD1 b, CD16, HLA-DR, and CD8. In some embodiments, the antibody or binding partner is bound to a solid support or matrix, such as a magnetic bead or paramagnetic bead, to allow for separation of cells for positive and/or negative selection. For example, in some embodiments, the cells and cell populations are separated or isolated using immunomagnetic (or affinitymagnetic) separation techniques (reviewed in Methods in Molecular Medicine, vol. 58: Metastasis Research Protocols, Vol. 2: Cell Behavior In Vitro and In Vivo, p 17-25 Edited by: S. A. Brooks and U. Schumacher© Humana Press Inc., Totowa, N.J.).

In some aspects, the sample or composition of cells to be separated is incubated with small, magnetizable or magnetically responsive material, such as magnetically responsive particles or microparticles, such as paramagnetic beads (e.g., such as Dynalbeads or MACS beads). The magnetically responsive material, e.g., particle, generally is directly or indirectly attached to a binding partner, e.g., an antibody, that specifically binds to a molecule, e.g., surface marker, present on the cell, cells, or population of cells that it is desired to separate, e.g., that it is desired to negatively or positively select.

In some embodiments, the magnetic particle or bead comprises a magnetically responsive material bound to a specific binding member, such as an antibody or other binding partner. There are many well-known magnetically responsive materials used in magnetic separation methods. Suitable magnetic particles include those described in Molday, U.S. Pat. No. 4,452,773, and in European Patent Specification EP 452342 B, which are hereby incorporated by reference. Colloidal sized particles, such as those described in Owen U.S. Pat. No. 4,795,698, and Liberti et al., U.S. Pat. No. 5,200,084 are other examples.

The incubation generally is carried out under conditions whereby the antibodies or binding partners, or molecules, such as secondary antibodies or other reagents, which specifically bind to such antibodies or binding partners, which are attached to the magnetic particle or bead, specifically bind to cell surface molecules if present on cells within the sample.

In some aspects, the sample is placed in a magnetic field, and those cells having magnetically responsive or magnetizable particles attached thereto will be attracted to the magnet and separated from the unlabeled cells. For positive selection, cells that are attracted to the magnet are retained; for negative selection, cells that are not attracted (unlabeled cells) are retained. In some aspects, a combination of positive and negative selection is performed during the same selection step, where the positive and negative fractions are retained and further processed or subject to further separation steps.

In certain embodiments, the magnetically responsive particles are coated in primary antibodies or other binding partners, secondary antibodies, lectins, enzymes, or streptavidin. In certain embodiments, the magnetic particles are attached to cells via a coating of primary antibodies specific for one or more markers. In certain embodiments, the cells, rather than the beads, are labeled with a primary antibody or binding partner, and then cell-type specific secondary antibody- or other binding partner (e.g., streptavidin)-coated magnetic particles, are added. In certain embodiments, streptavidin-coated magnetic particles are used in conjunction with biotinylated primary or secondary antibodies.

In some embodiments, the magnetically responsive particles are left attached to the cells that are to be subsequently incubated, cultured and/or engineered; in some aspects, the particles are left attached to the cells for administration to a patient. In some embodiments, the magnetizable or magnetically responsive particles are removed from the cells. Methods for removing magnetizable particles from cells are known and include, e.g., the use of competing non-labeled antibodies, magnetizable particles or antibodies conjugated to cleavable linkers, etc. In some embodiments, the magnetizable particles are biodegradable.

In some embodiments, the affinity-based selection is via magnetic-activated cell sorting (MACS) (Miltenyi Biotec, Auburn, Calif.). Magnetic Activated Cell Sorting (MACS) systems are capable of high-purity selection of cells having magnetized particles attached thereto. In certain embodiments, MACS operates in a mode wherein the non-target and target species are sequentially eluted after the application of the external magnetic field. That is, the cells attached to magnetized particles are held in place while the unattached species are eluted. Then, after this first elution step is completed, the species that were trapped in the magnetic field and were prevented from being eluted are freed in some manner such that they can be eluted and recovered. In certain embodiments, the non-target cells are labelled and depleted from the heterogeneous population of cells.

In certain embodiments, the isolation or separation is carried out using a system, device, or apparatus that carries out one or more of the isolation, cell preparation, separation, processing, incubation, culture, and/or formulation steps of the methods. In some aspects, the system is used to carry out each of these steps in a closed or sterile environment, for example, to minimize error, user handling and/or contamination. In one example, the system is a system as described in International Patent Application, Publication Number WO2009/072003, or US 2011/0003380 A1.

In some embodiments, the system or apparatus carries out one or more, e.g., all, of the isolation, processing, engineering, and formulation steps in an integrated or self-contained system, and/or in an automated or programmable fashion. In some aspects, the system or apparatus includes a computer and/or computer program in communication with the system or apparatus, which allows a user to program, control, assess the outcome of, and/or adjust various aspects of the processing, isolation, engineering, and formulation steps.

In some aspects, the separation and/or other steps is carried out using CliniMACS system (Miltenyi Biotec), for example, for automated separation of cells on a clinical-scale level in a closed and sterile system. Components can include an integrated microcomputer, magnetic separation unit, peristaltic pump, and various pinch valves. The integrated computer in some aspects controls all components of the instrument and directs the system to perform repeated procedures in a standardized sequence. The magnetic separation unit in some aspects includes a movable permanent magnet and a holder for the selection column. The peristaltic pump controls the flow rate throughout the tubing set and, together with the pinch valves, ensures the controlled flow of buffer through the system and continual suspension of cells.

The CliniMACS system in some aspects uses antibody-coupled magnetizable particles that are supplied in a sterile, non-pyrogenic solution. In some embodiments, after labelling of cells with magnetic particles the cells are washed to remove excess particles. A cell preparation bag is then connected to the tubing set, which in turn is connected to a bag containing buffer and a cell collection bag. The tubing set consists of pre-assembled sterile tubing, including a pre-column and a separation column, and are for single use only. After initiation of the separation program, the system automatically applies the cell sample onto the separation column. Labelled cells are retained within the column, while unlabeled cells are removed by a series of washing steps. In some embodiments, the cell populations for use with the methods described herein are unlabeled and are not retained in the column. In some embodiments, the cell populations for use with the methods described herein are labeled and are retained in the column. In some embodiments, the cell populations for use with the methods described herein are eluted from the column after removal of the magnetic field, and are collected within the cell collection bag.

In certain embodiments, separation and/or other steps are carried out using the CliniMACS Prodigy system (Miltenyi Biotec). The CliniMACS Prodigy system in some aspects is equipped with a cell processing unity that permits automated washing and fractionation of cells by centrifugation. The CliniMACS Prodigy system can also include an onboard camera and image recognition software that determines the optimal cell fractionation endpoint by discerning the macroscopic layers of the source cell product. For example, peripheral blood may be automatically separated into erythrocytes, white blood cells and plasma layers. The CliniMACS Prodigy system can also include an integrated cell cultivation chamber which accomplishes cell culture protocols such as, e.g., cell differentiation and expansion, antigen loading, and long-term cell culture. Input ports can allow for the sterile removal and replenishment of media and cells can be monitored using an integrated microscope. See, e.g., Klebanoff et al. (2012) J Immunother. 35(9): 651-660, Terakura et al. (2012) Blood. 1:72-82, and Wang et al. (2012) J Immunother. 35(9):689-701.

In some embodiments, a cell population described herein is collected and enriched (or depleted) via flow cytometry, in which cells stained for multiple cell surface markers are carried in a fluidic stream. In some embodiments, a cell population described herein is collected and enriched (or depleted) via preparative scale (FACS)-sorting. In certain embodiments, a cell population described herein is collected and enriched (or depleted) by use of microelectromechanical systems (MEMS) chips in combination with a FACS-based detection system (see, e.g., WO 2010/033140, Cho et al. (2010) Lab Chip 10, 1567-1573; and Godin et al. (2008) J Biophoton. 1(5):355-376. In both cases, cells can be labeled with multiple markers, allowing for the isolation of well-defined T cell subsets at high purity.

In some embodiments, the antibodies or binding partners are labeled with one or more detectable marker, to facilitate separation for positive and/or negative selection. For example, separation may be based on binding to fluorescently labeled antibodies. In some examples, separation of cells based on binding of antibodies or other binding partners specific for one or more cell surface markers are carried in a fluidic stream, such as by fluorescence-activated cell sorting (FACS), including preparative scale (FACS) and/or microelectromechanical systems (MEMS) chips, e.g., in combination with a flow-cytometric detection system. Such methods allow for positive and negative selection based on multiple markers simultaneously.

In some embodiments, the preparation methods include steps for freezing, e.g., cryopreserving, the cells, either before or after isolation, incubation, and/or engineering. In some embodiments, the freeze and subsequent thaw step removes granulocytes and, to some extent, monocytes in the cell population. In some embodiments, the cells are suspended in a freezing solution, e.g., following a washing step to remove plasma and platelets. Any of a variety of known freezing solutions and parameters in some aspects may be used. One example involves using PBS containing 20% DMSO and 8% human serum albumin (HSA), or other suitable cell freezing media. This is then diluted 1:1 with media so that the final concentration of DMSO and HSA are 10% and 4%, respectively. The cells are then frozen to −80° C. at a rate of 10 per minute and stored in the vapor phase of a liquid nitrogen storage tank.

In some embodiments, the provided methods include cultivation, incubation, culture, and/or genetic engineering steps. For example, in some embodiments, provided are methods for incubating and/or engineering the depleted cell populations and culture-initiating compositions.

Thus, in some embodiments, the cell populations are incubated in a culture-initiating composition. The incubation and/or engineering may be carried out in a culture vessel, such as a unit, chamber, well, column, tube, tubing set, valve, vial, culture dish, bag, or other container for culture or cultivating cells.

In some embodiments, the cells are incubated and/or cultured prior to or in connection with genetic engineering. The incubation steps can include culture, cultivation, stimulation, activation, and/or propagation. In some embodiments, the compositions or cells are incubated in the presence of stimulating conditions or a stimulatory agent. Such conditions include those designed to induce proliferation, expansion, activation, and/or survival of cells in the population, to mimic antigen exposure, and/or to prime the cells for genetic engineering, such as for the introduction of an antigen receptor.

The conditions can include one or more of particular media, temperature, oxygen content, carbon dioxide content, time, agents, e.g., nutrients, amino acids, antibiotics, ions, and/or stimulatory factors, such as cytokines, chemokines, antigens, binding partners, fusion proteins, recombinant soluble receptors, and any other agents designed to activate the cells.

In some embodiments, the stimulating conditions or agents include one or more agent, e.g., ligand, which is capable of activating an intracellular signaling domain of a TCR complex. In some aspects, the agent turns on or initiates TCR/CD3 intracellular signaling cascade in a T cell. Such agents can include antibodies, such as those specific for a TCR component and/or costimulatory receptor, e.g., anti-CD3. In some embodiments, the stimulating conditions include one or more agent, e.g. ligand, which is capable of stimulating a costimulatory receptor, e.g., anti-CD28. In some embodiments, such agents and/or ligands may be, bound to solid support such as a bead, and/or one or more cytokines. Optionally, the expansion method may further comprise the step of adding anti-CD3 and/or anti-CD28 antibody to the culture medium (e.g., at a concentration of at least about 0.5 ng/ml). In some embodiments, the stimulating agents include IL-2, IL-15 and/or IL-7. In some aspects, the IL-2 concentration is at least about 10 units/mL.

In some aspects, incubation is carried out in accordance with techniques such as those described in U.S. Pat. No. 6,040,177 to Riddell et al., Klebanoff et al. (2012) J Immunother. 35(9): 651-660, Terakura et al. (2012) Blood. 1:72-82, and/or Wang et al. (2012) J Immunother. 35(9):689-701.

In some embodiments, the T cells are expanded by adding to the culture-initiating composition feeder cells, such as non-dividing peripheral blood mononuclear cells (PBMC), (e.g., such that the resulting population of cells contains at least about 5, 10, 20, or 40 or more PBMC feeder cells for each T lymphocyte in the initial population to be expanded); and incubating the culture (e.g. for a time sufficient to expand the numbers of T cells). In some aspects, the non-dividing feeder cells can comprise gamma-irradiated PBMC feeder cells. In some embodiments, the PBMC are irradiated with gamma rays in the range of about 3000 to 3600 rads to prevent cell division. In some aspects, the feeder cells are added to culture medium prior to the addition of the populations of T cells.

In some embodiments, the stimulating conditions include temperature suitable for the growth of human T lymphocytes, for example, at least about 25 degrees Celsius, generally at least about 30 degrees, and generally at or about 37 degrees Celsius. Optionally, the incubation may further comprise adding non-dividing EBV-transformed lymphoblastoid cells (LCL) as feeder cells. LCL can be irradiated with gamma rays in the range of about 6000 to 10,000 rads. The LCL feeder cells in some aspects is provided in any suitable amount, such as a ratio of LCL feeder cells to initial T lymphocytes of at least about 10:1.

In embodiments, antigen-specific T cells, such as antigen-specific CD4+ and/or CD8+ T cells, are obtained by stimulating naive or antigen specific T lymphocytes with antigen. For example, antigen-specific T cell lines or clones can be generated to cytomegalovirus antigens by isolating T cells from infected subjects and stimulating the cells in vitro with the same antigen.

B. Vectors and Methods for Genetic Engineering

Also provided are methods, nucleic acids, compositions, and kits, for expressing the binding molecules, and for producing the genetically engineered cells expressing such binding molecules. The genetic engineering generally involves introduction of a nucleic acid encoding the binding molecule, e.g. TCR or CAR, e.g. TCR-like CAR, into the cell, such as by retroviral transduction, transfection, or transformation.

In some embodiments, gene transfer is accomplished by first stimulating the cell, such as by combining it with a stimulus that induces a response such as proliferation, survival, and/or activation, e.g., as measured by expression of a cytokine or activation marker, followed by transduction of the activated cells, and expansion in culture to numbers sufficient for clinical applications.

In some contexts, overexpression of a stimulatory factor (for example, a lymphokine or a cytokine) may be toxic to a subject. Thus, in some contexts, the engineered cells include gene segments that cause the cells to be susceptible to negative selection in vivo, such as upon administration in adoptive immunotherapy. For example in some aspects, the cells are engineered so that they can be eliminated as a result of a change in the in vivo condition of the patient to which they are administered. The negative selectable phenotype may result from the insertion of a gene that confers sensitivity to an administered agent, for example, a compound. Negative selectable genes include the Herpes simplex virus type I thymidine kinase (HSV-I TK) gene (Wigler et al., Cell 2:223, 1977) which confers ganciclovir sensitivity; the cellular hypoxanthine phosphribosyltransferase (HPRT) gene, the cellular adenine phosphoribosyltransferase (APRT) gene, bacterial cytosine deaminase, (Mullen et al., Proc. Natl. Acad. Sci. USA. 89:33 (1992)).

In some aspects, the cells further are engineered to promote expression of cytokines or other factors. Various methods for the introduction of genetically engineered components are well known and may be used with the provided methods and compositions. Exemplary methods include those for transfer of nucleic acids encoding the binding molecules, including via viral, e.g., retroviral or lentiviral, transduction, transposons, and electroporation.

In some embodiments, recombinant nucleic acids are transferred into cells using recombinant infectious virus particles, such as, e.g., vectors derived from simian virus 40 (SV40), adenoviruses, adeno-associated virus (AAV). In some embodiments, recombinant nucleic acids are transferred into T cells using recombinant lentiviral vectors or retroviral vectors, such as gamma-retroviral vectors (see, e.g., Koste et al. (2014) Gene Therapy 2014 Apr. 3. doi: 10.1038/gt.2014.25; Carlens et al. (2000) Exp Hematol 28(10): 1137-46; Alonso-Camino et al. (2013) Mol Ther Nucl Acids 2, e93; Park et al., Trends Biotechnol. 2011 Nov. 29(11): 550-557.

In some embodiments, the retroviral vector has a long terminal repeat sequence (LTR), e.g., a retroviral vector derived from the Moloney murine leukemia virus (MoMLV), myeloproliferative sarcoma virus (MPSV), murine embryonic stem cell virus (MESV), murine stem cell virus (MSCV), or spleen focus forming virus (SFFV). Most retroviral vectors are derived from murine retroviruses. In some embodiments, the retroviruses include those derived from any avian or mammalian cell source. The retroviruses typically are amphotropic, meaning that they are capable of infecting host cells of several species, including humans. In one embodiment, the gene to be expressed replaces the retroviral gag, pol and/or env sequences. A number of illustrative retroviral systems have been described (e.g., U.S. Pat. Nos. 5,219,740; 6,207,453; 5,219,740; Miller and Rosman (1989) BioTechniques 7:980-990; Miller, A. D. (1990) Human Gene Therapy 1:5-14; Scarpa et al. (1991) Virology 180:849-852; Burns et al. (1993) Proc. Natl. Acad. Sci. USA 90:8033-8037; and Boris-Lawrie and Temin (1993) Cur. Opin. Genet. Develop. 3:102-109.

Methods of lentiviral transduction are known. Exemplary methods are described in, e.g., Wang et al. (2012) *J. Immunother.* 35(9): 689-701; Cooper et al. (2003) *Blood.* 101: 1637-1644; Verhoeyen et al. (2009)*Methods Mol Biol.* 506: 97-114; and Cavalieri et al. (2003) *Blood.* 102(2): 497-505.

In some embodiments, recombinant nucleic acids are transferred into T cells via electroporation (see, e.g., Chicaybam et al, (2013) *PLoS ONE* 8(3): e60298 and Van Tedeloo et al. (2000) *Gene Therapy* 7(16): 1431-1437). In some embodiments, recombinant nucleic acids are transferred into T cells via transposition (see, e.g., Manuri et al. (2010) *Hum Gene Ther* 21(4): 427-437; Sharma et al. (2013) *Molec Ther Nucl Acids* 2, e74; and Huang et al. (2009) *Methods Mol Biol* 506: 115-126). Other methods of introducing and expressing genetic material in immune cells include calcium phosphate transfection (e.g., as described in Current Protocols in Molecular Biology, John Wiley & Sons, New York. N.Y.), protoplast fusion, cationic liposome-mediated transfection; tungsten particle-facilitated microparticle bombardment (Johnston, Nature, 346: 776-777 (1990)); and strontium phosphate DNA co-precipitation (Brash et al., Mol. Cell Biol., 7: 2031-2034 (1987)).

Other approaches and vectors for transfer of the nucleic acids encoding the binding molecules or recombinant products are those described, e.g., in international patent application, Publication No.: WO2014/055668, and U.S. Pat. No. 7,446,190.

Among additional nucleic acids, e.g., genes for introduction are those to improve the efficacy of therapy, such as by promoting viability and/or function of transferred cells; genes to provide a genetic marker for selection and/or evaluation of the cells, such as to assess in vivo survival or localization; genes to improve safety, for example, by making the cell susceptible to negative selection in vivo as described by Lupton S. D. et al., *Mol. and Cell Biol.*, 11:6 (1991); and Riddell et al., *Human Gene Therapy* 3:319-338 (1992); see also the publications of PCT/US91/08442 and PCT/US94/05601 by Lupton et al. describing the use of bifunctional selectable fusion genes derived from fusing a dominant positive selectable marker with a negative selectable marker. See, e.g., Riddell et al., U.S. Pat. No. 6,040,177, at columns 14-17.

Thus, provided in some embodiments are engineered cells, such as those containing a binding molecule (such as TCR or antigen-binding fragment thereof or antibody or antigen-binding fragment thereof), nucleic acid, or vector as described herein. In some aspects, the cell is produced by transducing the cell in vitro or ex vivo with a vector described herein. In some aspects, the cell is a T cell, such as a CD8+ or CD4+ T cell. In some embodiments, the binding molecule is heterologous to the cell.

V. COMPOSITIONS, METHODS, AND USES

Also provided are compositions including the binding molecules, e.g. TCRs, and engineered cells, including pharmaceutical compositions and formulations, and methods of using and uses of the molecules and compositions, such as in the treatment of diseases, conditions, and disorders in which HPV16 E6 or E7 is expressed, and/or detection, diagnostic, and prognostic methods.

C. Pharmaceutical Compositions and Formulations

Provided are pharmaceutical formulations including the binding molecules, e.g., TCR or antigen-binding fragment thereof or antibody or antigen-binding fragment thereof, and/or the engineered cells expressing the binding molecules. The pharmaceutical compositions and formulations generally include one or more optional pharmaceutically acceptable carrier or excipient. In some embodiments, the composition includes at least one additional therapeutic agent.

The term "pharmaceutical formulation" refers to a preparation which is in such form as to permit the biological activity of an active ingredient contained therein to be effective, and which contains no additional components which are unacceptably toxic to a subject to which the formulation would be administered.

A "pharmaceutically acceptable carrier" refers to an ingredient in a pharmaceutical formulation, other than an active ingredient, which is nontoxic to a subject. A pharmaceutically acceptable carrier includes, but is not limited to, a buffer, excipient, stabilizer, or preservative.

In some aspects, the choice of carrier is determined in part by the particular cell or binding molecule, and/or by the method of administration. Accordingly, there are a variety of suitable formulations. For example, the pharmaceutical composition can contain preservatives. Suitable preservatives may include, for example, methylparaben, propylparaben, sodium benzoate, and benzalkonium chloride. In some aspects, a mixture of two or more preservatives is used. The preservative or mixtures thereof are typically present in an amount of about 0.0001% to about 2% by weight of the total composition. Carriers are described, e.g., by Remington's Pharmaceutical Sciences 16th edition, Osol, A. Ed. (1980). Pharmaceutically acceptable carriers are generally nontoxic to recipients at the dosages and concentrations employed, and include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG).

Buffering agents in some aspects are included in the compositions. Suitable buffering agents include, for example, citric acid, sodium citrate, phosphoric acid, potassium phosphate, and various other acids and salts. In some aspects, a mixture of two or more buffering agents is used. The buffering agent or mixtures thereof are typically present in an amount of about 0.001% to about 4% by weight of the total composition. Methods for preparing administrable pharmaceutical compositions are known. Exemplary methods are described in more detail in, for example, Remington: The Science and Practice of Pharmacy, Lippincott Williams & Wilkins; 21st ed. (May 1, 2005).

Formulations of the binding molecules can include lyophilized formulations and aqueous solutions. The formulation or composition may also contain more than one active ingredient useful for the particular indication, disease, or condition being treated with the binding molecules or cells, preferably those with activities complementary to the binding molecule or cell, where the respective activities do not adversely affect one another. Such active ingredients are suitably present in combination in amounts that are effective for the purpose intended. Thus, in some embodiments, the pharmaceutical composition further includes other pharmaceutically active agents or drugs, such as chemotherapeutic agents, e.g., asparaginase, busulfan, carboplatin, cisplatin, daunorubicin, doxorubicin, fluorouracil, gemcitabine, hydroxyurea, methotrexate, paclitaxel, rituximab, vinblastine, vincristine, etc. In some embodiments, the binding molecules are administered in the form of a salt, e.g., a pharmaceutically acceptable salt. Suitable pharmaceutically acceptable acid addition salts include those derived from mineral acids, such as hydrochloric, hydrobromic, phosphoric, metaphosphoric, nitric, and sulphuric acids, and organic acids, such as tartaric, acetic, citric, malic, lactic, fumaric, benzoic, glycolic, gluconic, succinic, and arylsulphonic acids, for example, p-toluenesulphonic acid.

Active ingredients may be entrapped in microcapsules, in colloidal drug delivery systems (for example, liposomes, albumin microspheres, microemulsions, nano-particles and nanocapsules) or in macroemulsions. In certain embodiments, the pharmaceutical composition is formulated as an inclusion complex, such as cyclodextrin inclusion complex, or as a liposome. Liposomes can serve to target the host cells (e.g., T-cells or NK cells) to a particular tissue. Many methods are available for preparing liposomes, such as those described in, for example, Szoka et al., Ann. Rev. Biophys. Bioeng., 9: 467 (1980), and U.S. Pat. Nos. 4,235,871, 4,501,728, 4,837,028, and 5,019,369.

The pharmaceutical composition in some aspects can employ time-released, delayed release, and sustained release delivery systems such that the delivery of the composition occurs prior to, and with sufficient time to cause, sensitization of the site to be treated. Many types of release delivery systems are available and known. Such systems can avoid repeated administrations of the composition, thereby increasing convenience to the subject and the physician.

The pharmaceutical composition in some embodiments contains the binding molecules and/or cells in amounts effective to treat or prevent the disease or condition, such as a therapeutically effective or prophylactically effective amount. Therapeutic or prophylactic efficacy in some embodiments is monitored by periodic assessment of treated subjects. For repeated administrations over several days or longer, depending on the condition, the treatment is repeated until a desired suppression of disease symptoms occurs. However, other dosage regimens may be useful and can be determined. The desired dosage can be delivered by a single bolus administration of the composition, by multiple bolus administrations of the composition, or by continuous infusion administration of the composition.

In certain embodiments, in the context of genetically engineered cells containing the binding molecules, a subject is administered the range of at or about one million to at or about 200 billion cells, such as, e.g., 1 million to at or about 50 billion cells (e.g., at or about 5 million cells, at or about 25 million cells, at or about 500 million cells, at or about 1 billion cells, at or about 5 billion cells, at or about 20 billion cells, at or about 30 billion cells, at or about 40 billion cells, or a range defined by any two of the foregoing values), or such as at or about 10 million to at or about 100 billion cells (e.g., at or about 20 million cells, at or about 30 million cells, at or about 40 million cells, at or about 60 million cells, at or about 70 million cells, at or about 80 million cells, at or about 90 million cells, at or about 10 billion cells, at or about 25 billion cells, at or about 50 billion cells, at or about 75 billion cells, at or about 90 billion cells, or a range defined by any two of the foregoing values), and in some cases at or about 100 million cells to at or about 50 billion cells (e.g., at or about 120 million cells, at or about 250 million cells, at or about 350 million cells, at or about 450 million cells, at or about 650 million cells, at or about 800 million cells, at or about 900 million cells, at or about 3 billion cells, at or about 30 billion cells, at or about 45 billion cells) or any value in between these ranges, and/or such a number of cells per kilogram of body weight of the subject.

The cells or binding molecules may be administered using standard administration techniques, formulations, and/or devices. Provided are formulations and devices, such as syringes and vials, for storage and administration of the compositions. Administration of the cells can be autologous or heterologous. For example, immunoresponsive cells or progenitors can be obtained from one subject, and administered to the same subject or a different, compatible subject. Peripheral blood derived immunoresponsive cells or their progeny (e.g., in vivo, ex vivo or in vitro derived) can be administered via localized injection, including catheter administration, systemic injection, localized injection, intravenous injection, or parenteral administration. When administering a therapeutic composition (e.g., a pharmaceutical composition containing a genetically modified immunoresponsive cell), it will generally be formulated in a unit dosage injectable form (solution, suspension, emulsion).

Formulations include those for oral, intravenous, intraperitoneal, subcutaneous, pulmonary, transdermal, intramuscular, intranasal, buccal, sublingual, or suppository administration. In some embodiments, the cell populations are administered parenterally. The term "parenteral," as used herein, includes intravenous, intramuscular, subcutaneous, rectal, vaginal, intracranial, intrathoracic, and intraperitoneal administration. In some embodiments, the cell populations are administered to a subject using peripheral systemic delivery by intravenous, intraperitoneal, or subcutaneous injection.

Compositions in some embodiments are provided as sterile liquid preparations, e.g., isotonic aqueous solutions, suspensions, emulsions, dispersions, or viscous compositions, which may in some aspects be buffered to a selected pH. Liquid preparations are normally easier to prepare than gels, other viscous compositions, and solid compositions. Additionally, liquid compositions are somewhat more convenient to administer, especially by injection. Viscous compositions, on the other hand, can be formulated within the appropriate viscosity range to provide longer contact periods with specific tissues. Liquid or viscous compositions can comprise carriers, which can be a solvent or dispersing medium containing, for example, water, saline, phosphate buffered saline, polyol (for example, glycerol, propylene glycol, liquid polyethylene glycol) and suitable mixtures thereof.

Sterile injectable solutions can be prepared by incorporating the binding molecule in a solvent, such as in admixture with a suitable carrier, diluent, or excipient such as sterile water, physiological saline, glucose, dextrose, or the like.

The formulations to be used for in vivo administration are generally sterile. Sterility may be readily accomplished, e.g., by filtration through sterile filtration membranes.

D. Therapeutic and Prophylactic Methods and Uses

Also provided are methods of administering and uses, such as therapeutic and prophylactic uses, of the binding molecules, including TCRs and antigen-binding fragments thereof and antibodies or antigen-binding fragments thereof, and/or engineered cells expressing the binding molecules. Such methods and uses include therapeutic methods and uses, for example, involving administration of the molecules, cells, or compositions containing the same, to a subject having a disease, condition, or disorder expressing or associated with HPV, e.g., HPV16, and/or in which cells or tissues express, e.g., specifically express, HPV16, e.g., HPV16 E6 or E7. In some embodiments, the molecule, cell, and/or composition is administered in an effective amount to effect treatment of the disease or disorder. Uses include uses of the binding molecules and cells in such methods and treatments, and in the preparation of a medicament in order to carry out such therapeutic methods. In some embodiments, the methods are carried out by administering the binding molecules or cells, or compositions comprising the same, to the subject having, having had, or suspected of having the disease or condition. In some embodiments, the methods thereby treat the disease or condition or disorder in the subject.

As used herein, "treatment" (and grammatical variations thereof such as "treat" or "treating") refers to complete or partial amelioration or reduction of a disease or condition or disorder, or a symptom, adverse effect or outcome, or phenotype associated therewith. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. The terms do not imply complete curing of a disease or complete elimination of any symptom or effect(s) on all symptoms or outcomes.

As used herein, "delaying development of a disease" means to defer, hinder, slow, retard, stabilize, suppress and/or postpone development of the disease (such as cancer). This delay can be of varying lengths of time, depending on the history of the disease and/or individual being treated. As is evident to one skilled in the art, a sufficient or significant delay can, in effect, encompass prevention, in that the individual does not develop the disease. For example, a late stage cancer, such as development of metastasis, may be delayed.

"Preventing," as used herein, includes providing prophylaxis with respect to the occurrence or recurrence of a disease in a subject that may be predisposed to the disease but has not yet been diagnosed with the disease. In some embodiments, the provided molecules and compositions are used to delay development of a disease or to slow the progression of a disease.

As used herein, to "suppress" a function or activity is to reduce the function or activity when compared to otherwise same conditions except for a condition or parameter of interest, or alternatively, as compared to another condition. For example, a binding molecule or composition or cell which suppresses tumor growth reduces the rate of growth of the tumor compared to the rate of growth of the tumor in the absence of the binding molecule or composition or cell.

An "effective amount" of an agent, e.g., a pharmaceutical formulation, binding molecule, or cells, or composition, in the context of administration, refers to an amount effective, at dosages/amounts and for periods of time necessary, to achieve a desired result, such as a therapeutic or prophylactic result.

A "therapeutically effective amount" of an agent, e.g., a pharmaceutical formulation, binding molecule, or cells, refers to an amount effective, at dosages and for periods of time necessary, to achieve a desired therapeutic result, such as for treatment of a disease, condition, or disorder, and/or pharmacokinetic or pharmacodynamic effect of the treatment. The therapeutically effective amount may vary according to factors such as the disease state, age, sex, and weight of the subject, and the populations of cells administered. In some embodiments, the provided methods involve administering the binding molecules, cells, and/or compositions at effective amounts, e.g., therapeutically effective amounts.

A "prophylactically effective amount" refers to an amount effective, at dosages and for periods of time necessary, to achieve the desired prophylactic result. Typically but not necessarily, since a prophylactic dose is used in subjects prior to or at an earlier stage of disease, the prophylactically effective amount will be less than the therapeutically effective amount.

As used herein, a "subject" is a mammal, such as a human or other animal, and typically is human.

Among the diseases to be treated are cancers. In some embodiments, the cancer is an HPV-associated cancers, and any HPV-associated, e.g., HPV 16-associated, diseases or conditions or diseases or conditions in which an HPV oncoprotein, e.g., E6 or E7, such as an HPV 16 oncoprotein, e.g., HPV 16 E6 or E7 is expressed. In certain diseases and conditions, the viral protein such as the oncoprotein such as the HPV 16 E6 or E7 is expressed in or by malignant cells and cancers, and/or a peptide epitope thereof is expressed on such malignant cancers or tissues, such as by way of MHC presentation. In some embodiments, the disease or condition is an HPV 16-expressing cancer. In some embodiments, the cancer is a carcinoma, melanoma or other precancerous or cancerous state caused by or otherwise associated with HPV, such as HPV-16. In some embodiments, the carcinoma can be a squamous cell or adenocarionma. In some embodiments, the disease or condition can be characterized by an epithelial cell abnormality associated with oncogenic HPV infection, such as koilocytosis; hyperkeratosis; precancerous conditions encompassing intraepithelial neoplasias or intraepithelial lesion; high-grade dysplasias; and invasive or malignant cancers. Among the HPV 16-associated diseases or conditions that can be treated include, but are not limited to, cervical cancer, uterine cancer, anal cancer, colorectal cancer, vaginal cancer, vulvar cancer, penile cancer, oropharyngeal cancers, tonsil cancer, pharyngeal cancers (pharynx cancer), laryngeal cancer (larynx cancer), oral cancer, skin cancer, esophageal cancer, head and neck cancer such as a squamous cell carcinoma (SCC) head and neck cancer, or small cell lung cancer. In some embodiments, the disease or condition is a cervical carcinoma.

In some embodiments, the methods may include steps or features to identify a subject who has, is suspected to have, or is at risk for developing an HPV 16-associated disease or disorder (see e.g. U.S. Pat. Nos. 6,355,424 and 8,968,995) and/or the subject to be treated may be a subject identified to have or to be so at risk for having or developing such HPV-associated disease or condition or cancer. Hence, provided in some aspects are methods for identifying subjects with diseases or disorders associated with HPV 16 E6 or E7 expression and selecting them for treatment and/or treating such subjects, e.g., selectively treating such subjects, with a provided HPV 16 binding molecule, including in some aspects with cells engineered to express such binding molecules, including in some aspects any of the HPV 16 E6 or E7 TCRs or antigen binding fragments thereof or anti-HPV 16 E6 or E7 antibodies, e.g., antibody fragments and proteins containing the same, such as the chimeric receptors, e.g., TCR-like CARs, and/or engineered cells expressing the TCRs or CARs.

For example, a subject may be screened for the presence of a disease or disorder associated with HPV 16 E6 or E7 expression, such as an HPV 16 E6- or E7-expressing cancer. In some embodiments, the methods include screening for or detecting the presence of an HPV 16 E6- or E7-associated disease, e.g. a tumor. Thus, in some aspects, a sample may be obtained from a patient suspected of having a disease or disorder associated with HPV 16 E6 or E7 expression and assayed for the expression level of HPV 16 E6 or E7. In some aspects, a subject who tests positive for an HPV 16 E6- or E7-associated disease or disorder may be selected for treatment by the present methods, and may be administered a therapeutically effective amount of a binding molecule described herein, a CAR expressing such a binding molecule, cells containing the binding molecule, or a pharmaceutical composition thereof as described herein. In some embodiments, the methods can be used to monitor the size or density of an HPV 16 E6- or E7-expressing tissue, e.g. tumor, over time, e.g., before, during, or after treatment by the methods. In some aspects, subjects treated by methods provided herein have been selected or tested positive for HPV expression according to such methods, e.g., prior to initiation of or during treatment.

In some embodiments, administration of a provided HPV 16 binding molecule, including any of the HPV 16 E6 or E7 TCRs or antigen binding fragments thereof or anti-HPV 16 E6 or E7 antibodies, e.g., antibody fragments and proteins containing the same, such as the chimeric receptors, e.g., TCR-like CARs, and/or engineered cells expressing the TCRs or CARs, can be combined with another therapeutic for the treatment of an HPV disease. For example, the additional therapeutic treatment can include treatment with another anti-cancer agent for the treatment of cervical cancer. Suitable dosages for such a co-administered agent may be lowered due to the combined action (synergy) of the agent and the provide HPV 16 binding molecule.

In some embodiments, the subject has persistent or relapsed disease, e.g., following treatment with another HPV 16-specific binding molecule and/or cells expressing an HPV 16-targeting binding molecule and/or other therapy, including chemotherapy, radiation, and/or hematopoietic stem cell transplantation (HSCT), e.g., allogenic HSCT. In some embodiments, the administration effectively treats the subject despite the subject having become resistant to another HPV 16-targeted therapy. In some embodiments, the subject has not relapsed but is determined to be at risk for relapse, such as at a high risk of relapse, and thus the compound or composition is administered prophylactically, e.g., to reduce the likelihood of or prevent relapse.

In some embodiments, the treatment does not induce an immune response by the subject to the therapy, and/or does not induce such a response to a degree that prevents effective treatment of the disease or condition. In some aspects, the degree of immunogenicity and/or graft versus host response is less than that observed with a different but comparable treatment. For example, in the case of adoptive cell therapy using cells expressing TCRs or CARs including the provided binding molecules, the degree of immunogenicity in some embodiments is reduced compared to TCRs or CARs including a different binding molecule.

In some embodiments, the methods include adoptive cell therapy, whereby genetically engineered cells expressing the provided binding molecules are administered to subjects. Such administration can promote activation of the cells (e.g., T cell activation) in an HPV 16-targeted manner, such that the cells of the disease or disorder are targeted for destruction.

Thus, the provided methods and uses include methods and uses for adoptive cell therapy. In some embodiments, the methods include administration of the cells or a composition containing the cells to a subject, tissue, or cell, such as one having, at risk for, or suspected of having the disease, condition or disorder. In some embodiments, the cells, populations, and compositions are administered to a subject having the particular disease or condition to be treated, e.g., via adoptive cell therapy, such as adoptive T cell therapy. In some embodiments, the cells or compositions are administered to the subject, such as a subject having or at risk for the disease or condition. In some aspects, the methods thereby treat, e.g., ameliorate one or more symptom of the disease or condition, such as by lessening tumor burden in an HPV 16 E6- or E7-expressing cancer.

Methods for administration of cells for adoptive cell therapy are known and may be used in connection with the provided methods and compositions. For example, adoptive T cell therapy methods are described, e.g., in US Patent Application Publication No. 2003/0170238 to Gruenberg et al; U.S. Pat. No. 4,690,915 to Rosenberg; Rosenberg (2011) Nat Rev Clin Oncol. 8(10):577-85). See, e.g., Themeli et al. (2013) Nat Biotechnol. 31(10): 928-933; Tsukahara et al. (2013) Biochem Biophys Res Commun 438(1): 84-9; Davila et al. (2013) *PLoS ONE* 8(4): e61338.

In some embodiments, the cell therapy, e.g., adoptive cell therapy, e.g., adoptive T cell therapy, is carried out by autologous transfer, in which the cells are isolated and/or otherwise prepared from the subject who is to receive the cell therapy, or from a sample derived from such a subject. Thus, in some aspects, the cells are derived from a subject, e.g., patient, in need of a treatment and the cells, following isolation and processing are administered to the same subject.

In some embodiments, the cell therapy, e.g., adoptive cell therapy, e.g., adoptive T cell therapy, is carried out by allogeneic transfer, in which the cells are isolated and/or otherwise prepared from a subject other than a subject who is to receive or who ultimately receives the cell therapy, e.g., a first subject. In such embodiments, the cells then are administered to a different subject, e.g., a second subject, of the same species. In some embodiments, the first and second subjects are genetically identical. In some embodiments, the first and second subjects are genetically similar. In some embodiments, the second subject expresses the same HLA class or supertype as the first subject.

In some embodiments, the subject, to whom the cells, cell populations, or compositions are administered, is a primate, such as a human. In some embodiments, the primate is a monkey or an ape. The subject can be male or female and can be any suitable age, including infant, juvenile, adolescent, adult, and geriatric subjects. In some embodiments, the subject is a non-primate mammal, such as a rodent. In some examples, the patient or subject is a validated animal model for disease, adoptive cell therapy, and/or for assessing toxic outcomes such as cytokine release syndrome (CRS).

The provided binding molecules, such as TCRs and antigen-binding fragments thereof and antibodies and antigen-binding fragments thereof, and cells expressing the same, can be administered by any suitable means, for example, by injection, e.g., intravenous or subcutaneous injections, intraocular injection, periocular injection, subretinal injection, intravitreal injection, trans-septal injection, subscleral injection, intrachoroidal injection, intracameral injection, subconjectval injection, subconjuntival injection, sub-Tenon's injection, retrobulbar injection, peribulbar injection, or posterior juxtascleral delivery. In some embodiments, they are administered by parenteral, intrapulmonary, and intranasal, and, if desired for local treatment, intralesional administration. Parenteral infusions include intramuscular, intravenous, intraarterial, intraperitoneal, intracranial, intrathoracic, or subcutaneous administration. Dosing and administration may depend in part on whether the administration is brief or chronic. Various dosing schedules include but are not limited to single or multiple administrations over various time-points, bolus administration, and pulse infusion.

For the prevention or treatment of disease, the appropriate dosage of the binding molecule or cell may depend on the type of disease to be treated, the type of binding molecule, the severity and course of the disease, whether the binding molecule is administered for preventive or therapeutic purposes, previous therapy, the patient's clinical history and response to the binding molecule, and the discretion of the attending physician. The compositions and molecules and cells are in some embodiments suitably administered to the patient at one time or over a series of treatments.

In certain embodiments, in the context of genetically engineered cells containing the binding molecules, a subject is administered the range of at or about one million to at or about 200 billion cells, such as, e.g., 1 million to at or about 50 billion cells (e.g., at or about 5 million cells, at or about 25 million cells, at or about 500 million cells, at or about 1 billion cells, at or about 5 billion cells, at or about 20 billion cells, at or about 30 billion cells, at or about 40 billion cells, or a range defined by any two of the foregoing values), or such as at or about 10 million to at or about 100 billion cells (e.g., at or about 20 million cells, at or about 30 million cells, at or about 40 million cells, at or about 60 million cells, at or about 70 million cells, at or about 80 million cells, at or about 90 million cells, at or about 10 billion cells, at or about 25 billion cells, at or about 50 billion cells, at or about 75 billion cells, at or about 90 billion cells, or a range defined by any two of the foregoing values), and in some cases at or about 100 million cells to at or about 50 billion cells (e.g., at or about 120 million cells, at or about 250 million cells, at or about 350 million cells, at or about 450 million cells, at or about 650 million cells, at or about 800 million cells, at or about 900 million cells, at or about 3 billion cells, at or about 30 billion cells, at or about 45 billion cells) or any value in between these ranges, and/or such a number of cells per kilogram of body weight of the subject. In some embodiments, in the context of genetically engineered cells comprising the binding molecules, a subject is administered at or about 10 million cells, at or about 100 million cells, at or about 1 billion cells, at or about 10 billion cells, at or about 100 billion cells, or any value in between these ranges and/or per kilogram of body weight. Again, dosages may vary depending on attributes particular to the disease or disorder and/or patient and/or other treatments.

Dosages may vary depending on attributes particular to the disease or disorder and/or patient and/or other treatments. In some embodiments, such values refer to numbers of recombinant receptor-expressing cells.

In some embodiments, for example, where the subject is a human, the dose includes fewer than about $2\times10^{11}$ total recombinant receptor (e.g., TCR)-expressing cells, e.g., in the range of at or about $1\times10^6$ to at or about $1.5\times10^{11}$ total of such cells, such as at or about $1\times10^7$, $3\times10^7$, $1\times10^8$, $5\times10^8$, $1\times10^9$, $1\times10^{10}$, $5\times10^{10}$, $1\times10^{11}$, $1.25\times10^{11}$ total such cells, or the range between any two of the foregoing values. In some embodiments, for example, where the subject is a human, the dose includes more than at or about $1\times10^7$ total recombinant receptor (e.g., TCR)-expressing cells, and fewer than at or about $1\times10^{11}$ total recombinant receptor (e.g., TCR)-expressing cells, e.g., in the range of at or about $1\times10^7$ to at or about $1\times10^{11}$ such cells, such as at or about $5\times10^7$, $1\times10^8$, $5\times10^8$, $1\times10^9$, $1\times10^{10}$, $5\times10^{10}$, $7.5\times10^{10}$, $1\times10^{11}$ total of such cells, or the range between any two of the foregoing values.

In some embodiments, the dose of genetically engineered cells comprises from at or about $1\times10^6$ to at or about $2\times10^{11}$ total TCR-expressing cells, from at or about $1\times10^6$ to at or about $1.5\times10^{11}$ total TCR-expressing cells, from at or about $1\times10^6$ to at or about $1\times10^{11}$ total TCR-expressing cells, from at or about $1\times10^6$ to at or about $5\times10^{10}$ total TCR-expressing cells, from at or about $1\times10^6$ to at or about $1\times10^{10}$ total TCR-expressing cells, from at or about $1\times10^6$ to at or about $1\times10^9$ total TCR-expressing cells, from at or about $1\times10^6$ to at or about $5\times10^8$ total TCR-expressing cells, from at or about $1\times10^6$ to at or about $1\times10^8$ total TCR-expressing cells, from at or about $1\times10^6$ to at or about $5\times10^7$ total TCR-expressing cells, from at or about $1\times10^6$ to at or about $1\times10^7$ total TCR-expressing cells, from at or about $1\times10^6$ to at or about $5\times10^6$ total TCR-expressing cells, from at or about $1\times10^6$ to at or about $2.5\times10^6$ total TCR-expressing cells, from at or about $1\times10^6$ to at or about $2\times10^6$ total TCR-expressing cells, from at or about $2\times10^6$ to at or about $2\times10^{11}$ total TCR-expressing cells, from at or about $2.5\times10^6$ to at or about $2\times10^{11}$ total TCR-expressing cells, from at or about $5\times10^6$ to at or about $2\times10^{11}$ total TCR-expressing cells, from at or about $1\times10^7$ to at or about $2\times10^{11}$ total TCR-expressing cells, from at or about $3\times10^7$ to at or about $2\times10^{11}$ total TCR-expressing cells, from at or about $1\times10^8$ to at or about $2\times10^{11}$ total TCR-expressing cells, from at or about $5\times10^8$ to at or about $2\times10^{11}$ total TCR-expressing cells, from at or about $1\times10^9$ to at or about $2\times10^{11}$ total TCR-expressing cells, from at or about $1\times10^{10}$ to at or about $2\times10^{11}$ total TCR-expressing cells, from at or about $5\times10^{10}$ to at or about $2\times10^{11}$ total TCR-expressing cells, from at or about $1\times10^6$ to at or about $2\times10^{11}$ total TCR-expressing cells, from at or about $1.5\times10^{10}$ to at or about $2\times10^{11}$ total TCR-expressing cells. In some embodiments, the dose of genetically engineered cells comprises from or from about $1\times10^7$ to at or about $1\times10^{11}$ total TCR-expressing cells, such as from or from about $1\times10^9$ to or to about $1\times10^{10}$ total TCR-expressing cells.

In some embodiments, the dose of genetically engineered cells comprises at least at or about $2\times10^{11}$ TCR-expressing cells, at least at or about $1.75\times10^{11}$ TCR-expressing cells, at least at or about $1.5\times10^{11}$ TCR-expressing cells, at least at or about $1.25\times10^{11}$ TCR-expressing cells, at least at or about $1\times10^{11}$ TCR-expressing cells, at least at or about $7.5\times10^{10}$ TCR-expressing cells, at least at or about $5\times10^{10}$ TCR-expressing cells, at least at or about $2.5\times10^{10}$ TCR-expressing cells, at least at or about $1\times10^{10}$ TCR-expressing cells, at least at or about $5\times10^9$ TCR-expressing cells, at least at or about $1\times10^9$ TCR-expressing cells, at least at or about $5\times10^8$ TCR-expressing cells, at least at or about $6\times10^7$ TCR-expressing cells, at least at or about $3\times10^7$ TCR-expressing cells, at least at or about $1\times10^7$ TCR-expressing cells, at least at or about $5\times10^6$ TCR-expressing cells, at least at or about $1\times10^6$ TCR-expressing cells.

In some embodiments, the dose of genetically engineered cells comprises at or about $2\times10^{11}$ TCR-expressing cells, at or about $1.75\times10^{11}$ TCR-expressing cells, at or about $1.5\times10^{11}$ TCR-expressing cells, at or about $1.25\times10^{11}$ TCR-expressing cells, at or about $1\times10^{11}$ TCR-expressing cells, at or about $7.5\times10^{10}$ TCR-expressing cells, at or about $5\times10^{10}$ TCR-expressing cells, at or about $2.5\times10^{10}$ TCR-expressing cells, at or about $1\times10^{10}$ TCR-expressing cells, at or about $5\times10^9$ TCR-expressing cells, at or about $1\times10^9$ TCR-expressing cells, at or about $5\times10^8$ TCR-expressing cells at or about $1\times10^8$ TCR-expressing cells, at or about $5\times10^7$ TCR-expressing cells, at or about $3\times10^7$ TCR-expressing cells, at or about $1\times10^7$ TCR-expressing cells, at or about $5\times10^6$ TCR-expressing cells, at or about $1\times10^6$ TCR-expressing cells.

In some embodiments, the dose of cells, e.g., recombinant receptor-expressing T cells (e.g., TCR-expressing cells), is administered to the subject as a single dose or is administered only one time within a period of two weeks, one month, three months, six months, 1 year or more. In some embodiments, the subject is administered one or more doses.

In some embodiments, the binding molecules or cells are administered as part of a combination treatment, such as simultaneously with or sequentially with, in any order, another therapeutic intervention, such as another TCR, antibody or engineered cell or receptor or agent, such as a cytotoxic or therapeutic agent.

The cells or antibodies in some embodiments are co-administered with one or more additional therapeutic agents or in connection with another therapeutic intervention, either simultaneously or sequentially in any order. In some contexts, the cells are co-administered with another therapy sufficiently close in time such that the cell populations enhance the effect of one or more additional therapeutic agents, or vice versa. In some embodiments, the cells or antibodies are administered prior to the one or more additional therapeutic agents. In some embodiments, the cells or antibodies are administered after to the one or more additional therapeutic agents.

Once the cells are administered to a mammal (e.g., a human), the biological activity of the engineered cell populations and/or binding molecules in some aspects is measured by any of a number of known methods. Parameters to assess include specific binding of an engineered or natural T cell or other immune cell to antigen, in vivo, e.g., by imaging, or ex vivo, e.g., by ELISA or flow cytometry. In certain embodiments, the ability of the engineered cells to destroy target cells can be measured using any suitable method known in the art, such as cytotoxicity assays described in, for example, Kochenderfer et al., J. Immunotherapy, 32(7): 689-702 (2009), and Herman et al. J. Immunological Methods, 285(1): 25-40 (2004). In certain embodiments, the biological activity of the cells also can be measured by assaying expression and/or secretion of certain cytokines, such as CD 107a, IFNγ, IL-2, and TNF. In some aspects the biological activity is measured by assessing clinical outcome, such as reduction in tumor burden or load.

In certain embodiments, engineered cells are modified in any number of ways, such that their therapeutic or prophylactic efficacy is increased. For example, the engineered TCRs or antibody-expressing CARs expressed by the engineered cells in some embodiments are conjugated either directly or indirectly through a linker to a targeting moiety. The practice of conjugating compounds, e.g., the TCR or CAR, to targeting moieties is known in the art. See, for instance, Wadwa et al., J. Drug Targeting 3: 1 1 1 (1995), and U.S. Pat. No. 5,087,616.

E. Diagnostic and Detection Methods

Also provided are methods involving use of the provided binding molecules, e.g., TCRs or antigen-binding fragments thereof and antibodies and antigen-binding fragments thereof, in detection of HPV 16, e.g., HPV 16 E6 or HPV 16 E7, for example, in diagnostic and/or prognostic methods in association with a HPV 16-expressing disease or condition. The methods in some embodiments include incubating a biological sample with the binding molecule and/or administering the binding molecule to a subject. In certain embodiments, a biological sample includes a cell or tissue, such as tumor or cancer tissue. In certain binding molecule to a region or peptide epitope of HPV 16, e.g., HPV 16 E6 or E7, and detecting whether a complex is formed between the binding molecule and peptide epitope. Such a method may be an in vitro or in vivo method. In one embodiment, an anti-HPV 16 binding molecule is used to select subjects eligible for therapy with an anti-HPV 16 binding molecules or engineered cells comprising such molecules, e.g. where HPV 16, e.g., HPV 16 E6 or E7 is a biomarker for selection of patients.

In some embodiments, a sample, such as a cell, tissue sample, lysate, composition, or other sample derived therefrom is contacted with the binding molecule and binding or formation of a complex between the binding molecule and the sample (e.g., region or epitope of HPV16 in the sample) is determined or detected. When binding in the test sample is demonstrated or detected as compared to a reference cell of the same tissue type, it may indicate the presence of an associated disease or condition. In some embodiments, the sample is from human tissues.

Various methods known in the art for detecting specific binding molecule-antigen binding can be used. Exemplary immunoassays include fluorescence polarization immunoassay (FPIA), fluorescence immunoassay (FIA), enzyme immunoassay (EIA), nephelometric inhibition immunoassay (NIA), enzyme linked immunosorbent assay (ELISA), and radioimmunoassay (RIA). An indicator moiety, or label group, can be attached to the subject binding molecules and may be selected so as to meet the needs of various uses of the method which are often dictated by the availability of assay equipment and compatible immunoassay procedures. Exemplary labels include radionuclides (e.g. $^{125}$I, $^{131}$I, $^{35}$S, $^{3}$H, or $^{32}$P), enzymes (e.g., alkaline phosphatase, horseradish peroxidase, luciferase, or β-galactosidase), fluorescent moieties or proteins (e.g., fluorescein, rhodamine, phycoerythrin, GFP, or BFP), or luminescent moieties (e.g., Qdot™ nanoparticles supplied by the Quantum Dot Corporation, Palo Alto, Calif.). General techniques to be used in performing the various immunoassays noted above are known to those of ordinary skill in the art.

For purposes of diagnosis, the binding molecules can be labeled with a detectable moiety including but not limited to radioisotopes, fluorescent labels, and various enzyme-substrate labels know in the art. Methods of conjugating labels to binding molecules, e.g., TCRs or antibodies, are known in the art. In some embodiments, the binding molecules need not be labeled, and the presence thereof can be detected using a labeled antibody which binds to the binding molecules.

The provided binding molecules in some embodiments can be employed in any known assay method, such as competitive binding assays, direct and indirect sandwich assays, and immunoprecipitation assays. The binding molecules can also be used for in vivo diagnostic assays, such as in vivo imaging. Generally, the binding molecule is labeled with a radionuclide (such as $^{111}$In, $^{99}$Tc, $^{14}$C, $^{131}$I, $^{125}$I, or $^{3}$H) so that the cells or tissue of interest can be localized in vivo following administration to a subject. The binding molecule may also be used as staining reagent in pathology, e.g., using known techniques.

VI. ARTICLES OF MANUFACTURE

Also provided are articles of manufacture containing the provided binding molecules, e.g., TCRs, antibodies, and CARs and/or engineered cells, and/or compositions. The articles of manufacture may include a container and a label or package insert on or associated with the container. Suitable containers include, for example, bottles, vials, syringes, IV solution bags, etc. The containers may be formed from a variety of materials such as glass or plastic. The container in some embodiments holds a composition which is by itself or combined with another composition effective for treating, preventing and/or diagnosing the condition. In some embodiments, the container has a sterile access port. Exemplary containers include an intravenous solution bags, vials, including those with stoppers pierceable by a needle for injection. The label or package insert may indicate that the composition is used for treating the HPV 16 E6- or E7-expressing or-associated disease or condition. The article of manufacture may include (a) a first container with a composition contained therein, wherein the composition includes the antibody or engineered antigen receptor; and (b) a second container with a composition contained therein, wherein the composition includes a further agent, such as a cytotoxic or otherwise therapeutic agent. The article of manufacture may further include a package insert indicating that the compositions can be used to treat a particular condition. Alternatively, or additionally, the article of manufacture may further include another or the same container comprising a pharmaceutically-acceptable buffer. It may further include other materials such as other buffers, diluents, filters, needles, and/or syringes.

VII. DEFINITIONS

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

The terms "polypeptide" and "protein" are used interchangeably to refer to a polymer of amino acid residues, and are not limited to a minimum length. Polypeptides, including the provided antibodies and antibody chains and other peptides, e.g., linkers, may include amino acid residues including natural and/or non-natural amino acid residues. The terms also include post-expression modifications of the polypeptide, for example, glycosylation, sialylation, acetylation, phosphorylation, and the like. In some aspects, the polypeptides may contain modifications with respect to a native or natural sequence, as long as the protein maintains the desired activity. These modifications may be deliberate, as through site-directed mutagenesis, or may be accidental, such as through mutations of hosts which produce the proteins or errors due to PCR amplification.

An "isolated" nucleic acid refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

"Isolated nucleic acid encoding a TCR or an antibody" refers to one or more nucleic acid molecules encoding TCR alpha or beta chains (or fragments thereof) or antibody heavy and light chains (or fragments thereof), including such nucleic acid molecule(s) in a single vector or separate vectors, and such nucleic acid molecule(s) present at one or more locations in a host cell.

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

As used herein, "percent (%) amino acid sequence identity" and "percent identity" when used with respect to an amino acid sequence (reference polypeptide sequence) is defined as the percentage of amino acid residues in a candidate sequence (e.g., the subject antibody or fragment) that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared.

An amino acid substitution may include replacement of one amino acid in a polypeptide with another amino acid. Amino acid substitutions may be introduced into a binding molecule, e.g., TCR or antibody, of interest and the products screened for a desired activity, e.g., retained/improved antigen binding, decreased immunogenicity, or improved cytolytic activity.

Amino acids generally can be grouped according to the following common side-chain properties:
(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro;
(6) aromatic: Trp, Tyr, Phe.

In some embodiments, conservative substitutions can involve the exchange of a member of one of these classes for another member of the same class. In some embodiments, non-conservative amino acid substitutions can involve exchanging a member of one of these classes for another class.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors."

The term "package insert" is used to refer to instructions customarily included in commercial packages of therapeutic products, that contain information about the indications, usage, dosage, administration, combination therapy, contraindications and/or warnings concerning the use of such therapeutic products.

As used herein, the singular forms "a," "an," and "the" include plural referents unless the context clearly dictates otherwise. For example, "a" or "an" means "at least one" or "one or more." It is understood that aspects and variations described herein include "consisting" and/or "consisting essentially of" aspects and variations.

Throughout this disclosure, various aspects of the claimed subject matter are presented in a range format. It should be understood that the description in range format is merely for convenience and brevity and should not be construed as an inflexible limitation on the scope of the claimed subject matter. Accordingly, the description of a range should be considered to have specifically disclosed all the possible sub-ranges as well as individual numerical values within that range. For example, where a range of values is provided, it is understood that each intervening value, between the upper and lower limit of that range and any other stated or intervening value in that stated range is encompassed within the claimed subject matter. The upper and lower limits of these smaller ranges may independently be included in the smaller ranges, and are also encompassed within the claimed subject matter, subject to any specifically excluded limit in the stated range. Where the stated range includes one or both of the limits, ranges excluding either or both of those included limits are also included in the claimed subject matter. This applies regardless of the breadth of the range.

The term "about" as used herein refers to the usual error range for the respective value readily known to the skilled person in this technical field. Reference to "about" a value or parameter herein includes (and describes) embodiments that are directed to that value or parameter per se. For example, description referring to "about X" includes description of "X".

As used herein, a composition refers to any mixture of two or more products, substances, or compounds, including cells. It may be a solution, a suspension, liquid, powder, a paste, aqueous, non-aqueous or any combination thereof.

As used herein, a statement that a cell or population of cells is "positive" for a particular marker refers to the detectable presence on or in the cell of a particular marker, typically a surface marker. When referring to a surface marker, the term refers to the presence of surface expression as detected by flow cytometry, for example, by staining with an antibody that specifically binds to the marker and detecting said antibody, wherein the staining is detectable by flow cytometry at a level substantially above the staining detected carrying out the same procedure with an isotype-matched control under otherwise identical conditions and/or at a level substantially similar to that for cell known to be positive for the marker, and/or at a level substantially higher than that for a cell known to be negative for the marker.

As used herein, a statement that a cell or population of cells is "negative" for a particular marker refers to the absence of substantial detectable presence on or in the cell of a particular marker, typically a surface marker. When referring to a surface marker, the term refers to the absence of surface expression as detected by flow cytometry, for example, by staining with an antibody that specifically binds to the marker and detecting said antibody, wherein the staining is not detected by flow cytometry at a level substantially above the staining detected carrying out the same procedure with an isotype-matched control under otherwise identical conditions, and/or at a level substantially lower than that for cell known to be positive for the marker, and/or at a level substantially similar as compared to that for a cell known to be negative for the marker.

VIII. EXEMPLARY EMBODIMENTS

Among the provided embodiments are:

1. A T cell receptor (TCR) or antigen-binding fragment thereof, comprising an alpha chain comprising a variable alpha (Vα) region and a beta chain comprising a variable beta (Vβ) region, wherein:
the Vα region comprises the amino acid sequence set forth in any of SEQ ID NOs: 47, 77, 103, 126, 149, 169, 195, or 221 or an amino acid sequence that has at least 90%, 91%, 92%, 93%, 94%, 95%, 96%, 97%, 98%, or 99% sequence identity thereto; and/or
the Vβ region comprises the amino acid sequence set forth in any of SEQ ID NOs: 60, 88, 114, 137, 157, 180, 206, or 232, or an amino acid sequence that has at least 90%, 91%, 92%, 93%, 94%, 95%, 96%, 97%, 98%, or 99% sequence identity thereto.

2. A T cell receptor (TCR) or antigen-binding fragment thereof, comprising an alpha chain comprising a variable alpha (Vα) region and a beta chain comprising a variable beta (Vβ) region, wherein:
the Vα region comprises the amino acid sequence set forth in any of SEQ ID NOs: 47, 77, 103, 126, 149, 169, 195, or 221 or an amino acid sequence that has at least 90%, 91%, 92%, 93%, 94%, 95%, 96%, 97%, 98%, or 99% sequence identity thereto; and
the Vβ region comprises the amino acid sequence set forth in any of SEQ ID NOs: 60, 88, 114, 137, 157, 180, 206, or 232, or an amino acid sequence that has at least 90%, 91%, 92%, 93%, 94%, 95%, 96%, 97%, 98%, or 99% sequence identity thereto.

3. The T cell receptor (TCR) or antigen-binding fragment thereof of embodiment 1 or embodiment 2, wherein:
the Vα region comprises the amino acid sequence set forth in any of SEQ ID NOs: 47, 149, 169, 195, or 221 or an amino acid sequence that has at least 90%, 91%, 92%, 93%, 94%, 95%, 96%, 97%, 98%, or 99% sequence identity thereto; or
the Vα region comprises the amino acid sequence set forth in any of SEQ ID NOs: 103, 126, or an amino acid sequence that has at least 91%, 92%, 93%, 94%, 95%, 96%, 97%, 98%, or 99% sequence identity thereto.

4. A T cell receptor (TCR) or antigen-binding fragment thereof of any of embodiments 1-3, wherein:
the Vβ region comprises the amino acid sequence set forth in any of SEQ ID NOs: 60, 180, or 232, or an amino acid sequence that has at least 90%, 91%, 92%, 93%, 94%, 95%, 96%, 97%, 98%, or 99% sequence identity thereto;
the Vβ region comprises the amino acid sequence set forth in SEQ ID NO: 206, or an amino acid sequence that has at least 90.5%, 91%, 92%, 93%, 94%, 95%, 96%, 97%, 98%, or 99% sequence identity thereto;
the Vβ region comprises the amino acid sequence set forth in SEQ ID NOs: 114 or 137, or an amino acid sequence that has at least 97.5%, 98%, or 99% sequence identity thereto;
the Vβ region comprises the amino acid sequence set forth in SEQ ID NO: 157, or an amino acid sequence that has at least 98.5%, or 99% sequence identity thereto; or
the Vβ region comprises the amino acid sequence set forth in SEQ ID NO: 88, or an amino acid sequence that has at least 99.5% sequence identity thereto.

5. The TCR or antigen-binding fragment thereof of any of embodiments 1-4, wherein the TCR or antigen-binding fragment thereof binds to or recognizes a peptide epitope of human papillomavirus (HPV) 16 E7 in the context of an MHC molecule, the peptide epitope is or comprises E7(11-19) YMLDLQPET (SEQ ID NO: 271).

6. The TCR or antigen-binding fragment thereof of any of embodiments 1-5, wherein, the TCR or antigen-binding fragment thereof, when expressed on the surface of a T cell, stimulates cytotoxic activity against a target cancer cell, optionally wherein the target cancer cell contains HPV DNA sequences or expresses HPV 16, optionally wherein the target cancer cell is SCC152.

7. The TCR or antigen-binding fragment of embodiment 7, wherein the target cancer cell expresses a peptide epitope of human papillomavirus (HPV) 16 E7 in the context of an MHC molecule, the peptide epitope is or comprises E7(11-19) YMLDLQPET (SEQ ID NO: 271).

8. The TCR or antigen-binding fragment thereof of any of embodiments 1-7, wherein: the Vα region comprises a complementarity determining region 1 (CDR-1), a CDR-2, and a CDR-3, respectively comprising the CDR-1, the CDR-2, and the CDR-3 amino acid sequences contained within a Vα region amino acid sequence set forth in any of SEQ ID NOs: 47, 77, 103, 126, 149, 169, 195, or 221; and/or the Vβ region comprises a complementarity determining region 1 (CDR-1), a CDR-2, and a CDR-3, respectively comprising the CDR-1, the CDR-2, and the CDR-3 amino acid sequences contained within a Vβ region amino acid sequence set forth in any of SEQ ID NOs: 60, 88, 114, 137, 157, 180, 206, or 232.

9. The TCR or antigen-binding fragment of any of embodiments 1-8, wherein:

the Vα region comprises a complementarity determining region 3 (CDR-3) comprising the amino acid sequence set forth in any of SEQ ID NOs: 50, 80, 106, 129, 150, 172, 198, or 224; and/or the Vβ region comprises a complementarity determining region 3 (CDR-3) comprising an amino acid sequence set forth in any of SEQ ID NOs: 63, 91, 115, 138, 158, 183, 209, or 235.

10. The TCR or antigen-binding fragment thereof of embodiment 9, wherein the Vα region comprises:

a complementarity determining region 1 (CDR-1) comprising an amino acid sequence set forth in any of SEQ ID NOs: 48, 78, 104, 127, 170, 196, or 222; and/or a complementarity determining region 2 (CDR-2) comprising an amino acid sequence set forth in any of SEQ ID NOs: 49, 79, 105, 128, 171, 197, or 223.

11. The TCR or antigen-binding fragment thereof of embodiment 9 or embodiment 10, wherein the Vβ region comprises:

a complementarity determining region 1 (CDR-1) comprising the amino acid sequence set forth in any of SEQ ID NOs: 61, 89, 181, 207, or 233; and/or a complementarity determining region 2 (CDR-2) comprising the amino acid sequence set forth in SEQ ID NO: 62, 90, 182, 208, or 234.

12. The TCR or antigen-binding fragment thereof of any of embodiments 1-11, wherein:

the Vα region comprises a CDR-1, a CDR-2, and a CDR-3, comprising the amino acid sequences of SEQ ID NOs: 48, 49, and 50, respectively, and the Vβ region comprises a CDR-1, a CDR-2, and a CDR-3, comprising the amino acid sequences of SEQ ID NOs: 61, 62, and 63, respectively;

the Vα region comprises a CDR-1, a CDR-2, and a CDR-3, comprising the amino acid sequences of SEQ ID NOs: 78, 79, and 80, respectively, and the Vβ region comprises a CDR-1, a CDR-2, and a CDR-3, comprising the amino acid sequences of SEQ ID NOs: 89, 90, and 91, respectively;

the Vα region comprises a CDR-1, a CDR-2, and a CDR-3, comprising the amino acid sequences of SEQ ID NOs: 104, 105, and 106, respectively, and the Vβ region comprises a CDR-1, a CDR-2, and a CDR-3, comprising the amino acid sequences of SEQ ID NOs: 89, 90, and 115, respectively;

the Vα region comprises a CDR-1, a CDR-2, and a CDR-3, comprising the amino acid sequences of SEQ ID NOs: 127, 128, and 129, respectively, and the Vβ region comprises a CDR-1, a CDR-2, and a CDR-3, comprising the amino acid sequences of SEQ ID NOs: 89, 90, and 138, respectively;

the Vα region comprises a CDR-1, a CDR-2, and a CDR-3, comprising the amino acid sequences of SEQ ID NOs: 127, 128, and 150, respectively, and the Vβ region comprises a CDR-1, a CDR-2, and a CDR-3, comprising the amino acid sequences of SEQ ID NOs: 89, 90, and 158, respectively;

the Vα region comprises a CDR-1, a CDR-2, and a CDR-3, comprising the amino acid sequences of SEQ ID NOs: 170, 171, and 172, respectively, and the Vβ region comprises a CDR-1, a CDR-2, and a CDR-3, comprising the amino acid sequences of SEQ ID NOs: 181, 182, and 183 respectively;

the Vα region comprises a CDR-1, a CDR-2, and a CDR-3, comprising the amino acid sequences of SEQ ID NOs: 196, 197, and 198, respectively, and the Vβ region comprises a CDR-1, a CDR-2, and a CDR-3, comprising the amino acid sequences of SEQ ID NOs: 207, 208, and 209, respectively; or the Vα region comprises a CDR-1, a CDR-2, and a CDR-3, comprising the amino acid sequences of SEQ ID NOs: 222, 223, and 224, respectively, and the Vβ region comprises a CDR-1, a CDR-2, and a CDR-3, comprising the amino acid sequences of SEQ ID NOs: 233, 234, and 235, respectively.

13. The TCR or antigen-binding fragment thereof of any of embodiments 1-10, wherein:

the Vα and Vβ regions comprise the amino acid sequences of SEQ ID NOs: 47 and 60, respectively, or an amino acid sequence that has at least 90%, 91%, 92%, 93%, 94%, 95%, 96%, 97%, 98%, or 99% sequence identity thereto;

the Vα and Vβ regions comprise the amino acid sequences of SEQ ID NOs: 77 and 88, respectively, or an amino acid sequence that has at least 90%, 91%, 92%, 93%, 94%, 95%, 96%, 97%, 98%, or 99% sequence identity thereto;

the Vα and Vβ regions comprise the amino acid sequences of SEQ ID NOs: 77 and 88, respectively, or an amino acid sequence that has at least 90%, 91%, 92%, 93%, 94%, 95%, 96%, 97%, 98%, or 99.5% sequence identity thereto;

the Vα and Vβ regions comprise the amino acid sequences of SEQ ID NOs: 103 and 114, respectively, or an amino acid sequence that has at least 90%, 91%, 92%, 93%, 94%, 95%, 96%, 97.5%, 98%, or 99% sequence identity thereto;

the Vα and Vβ regions comprise the amino acid sequences of SEQ ID NOs: 126 and 137, respectively, or an amino acid sequence that has at least 90%, 91%, 92%, 93%, 94%, 95%, 96%, 97.5%, 98%, or 99% sequence identity thereto;

the Vα and Vβ regions comprise the amino acid sequences of SEQ ID NOs: 149 and 157, respectively, or an amino acid sequence that has at least 90%, 91%, 92%, 93%, 94%, 95%, 96%, 97%, 98.5%, or 99% sequence identity thereto;

the Vα and Vβ regions comprise the amino acid sequences of SEQ ID NOs: 169 and 180, respectively, or an amino acid sequence that has at least 90%, 91%, 92%, 93%, 94%, 95%, 96%, 97%, 98%, or 99% sequence identity thereto;

the Vα and Vβ regions comprise the amino acid sequences of SEQ ID NOs: 195 and 206, respectively, or an amino acid sequence that has at least 90.5%, 91%, 92%, 93%, 94%, 95%, 96%, 97%, 98%, or 99% sequence identity thereto; or the Vα and Vβ regions comprise the amino acid sequences of SEQ ID NOs: 221 and 232, respectively, or an amino acid sequence that has at least 90%, 91%, 92%, 93%, 94%, 95%, 96%, 97%, 98%, or 99% sequence identity thereto.

14. The TCR or antigen-binding fragment thereof of any of embodiments 1-12, wherein:

the Vα and Vβ regions comprise the amino acid sequences of SEQ ID NOs: 47 and 60, respectively;

the Vα and Vβ regions comprise the amino acid sequences of SEQ ID NOs: 77 and 88, respectively;

the Vα and Vβ regions comprise the amino acid sequences of SEQ ID NOs: 77 and 88, respectively;

the Vα and Vβ regions comprise the amino acid sequences of SEQ ID NOs: 103 and 114, respectively;

the Vα and Vβ regions comprise the amino acid sequences of SEQ ID NOs: 126 and 137, respectively;

the Vα and Vβ regions comprise the amino acid sequences of SEQ ID NOs: 149 and 157, respectively;

the Vα and Vβ regions comprise the amino acid sequences of SEQ ID NOs: 169 and 180, respectively;

the Vα and Vβ regions comprise the amino acid sequences of SEQ ID NOs: 195 and 206, respectively; or the Vα and Vβ regions comprise the amino acid sequences of SEQ ID NOs: 221 and 232, respectively.

15. The TCR or antigen-binding fragment thereof of any of embodiments 1-14, wherein:

the Vα region comprises a CDR-1, a CDR-2, and a CDR-3, comprising the amino acid sequences of SEQ ID NOs: 48, 49, and 50, respectively, and the Vβ region comprises a CDR-1, a CDR-2, and a CDR-3, comprising the amino acid sequences of SEQ ID NOs: 61, 62, and 63; and/or the Vα and Vβ regions comprise the amino acid sequences of SEQ ID NOs: 47 and 60, respectively.

16. The TCR or antigen-binding fragment thereof of any of embodiments 1-14, wherein:

the Vα region comprises a CDR-1, a CDR-2, and a CDR-3, comprising the amino acid sequences of SEQ ID NOs: 196, 197, and 198, respectively, and the Vβ region comprises a CDR-1, a CDR-2, and a CDR-3, comprising the amino acid sequences of SEQ ID NOs: 207, 208, and 209, respectively; and/or the Vα and Vβ regions comprise the amino acid sequences of SEQ ID NOs: 195 and 206, respectively.

17. The TCR or antigen-binding fragment thereof of any of embodiments 1-14, wherein:

the Vα region comprises a CDR-1, a CDR-2, and a CDR-3, comprising the amino acid sequences of SEQ ID NOs: 222, 223, and 224, respectively, and the Vβ region comprises a CDR-1, a CDR-2, and a CDR-3, comprising the amino acid sequences of SEQ ID NOs: 233, 234, and 235, respectively; and/or the Vα and Vβ regions comprise the amino acid sequences of SEQ ID NOs: 221 and 232, respectively.

18. The TCR or antigen-binding fragment thereof of any of embodiments 1-17, wherein the alpha chain further comprises an alpha constant (Cα) region and/or the beta chain further comprises a beta constant (Cβ) region.

19. The TCR or antigen-binding fragment thereof of embodiment 18, wherein the Cα and Cβ regions are mouse constant regions.

20. The TCR or antigen-binding fragment thereof of embodiment 18, wherein the Cα and Cβ regions are human constant regions.

21. The TCR or antigen-binding fragment thereof of any of embodiments 18-20, wherein the Cα and/or Cβ regions comprise introduction of one or more cysteine residues that are capable of forming one or more non-native disulfide bridges between the alpha chain and beta chain.

22. The TCR or antigen-binding fragment thereof of any of embodiment 18, 19 and 21, wherein:

the Cα region comprises the amino acid sequence set forth in SEQ ID NO: 15, or a sequence of amino acids that has at least 90% sequence identity thereto; and/or the Cβ region comprises the amino acid sequence set forth in SEQ ID NO: 30, or a sequence of amino acids that has at least 90% sequence identity thereto.

23. The TCR or antigen-binding fragment thereof of any of embodiments 18, 19, 21 and 22, wherein:

a) the alpha chain comprises the amino acid sequence set forth in SEQ ID NOs: 44, 74, 100, 123, 146, 166, 192, or 218, or a sequence of amino acids that has at least 90% sequence identity thereto; and/or the beta chain comprises the amino acid sequence set forth in SEQ ID NOs: 57, 85, 111, 134, 154, 177, 203, or 229, or a sequence of amino acids that has at least 90% sequence identity thereto; or b) the alpha and beta chains comprise the amino acid sequences of SEQ ID NOs: 44 and 57, respectively; the alpha and beta chains comprise the amino acid sequences of SEQ ID NOs: 74 and 85, respectively; the alpha and beta chains comprise the amino acid sequences of SEQ ID NOs: 100 and 111, respectively; the alpha and beta chains comprise the amino acid sequences of SEQ ID NOs: 123 and 134, respectively; the alpha and beta chains comprise the amino acid sequences of SEQ ID NOs: 146 and 154, respectively; the alpha and beta chains comprise the amino acid sequences of SEQ ID NOs: 166 and 177, respectively; the alpha and beta chains comprise the amino acid sequences of SEQ ID NOs: 192 and 202, respectively; or the alpha and beta chains comprise the amino acid sequences of SEQ ID NOs:218 and 229, respectively.

24. The TCR or antigen-binding fragment thereof of any of embodiment 18, 20 and 21, wherein:

the Cα region comprises the amino acid sequence set forth in SEQ ID NO: 14, or a sequence of amino acids that has at least 90% sequence identity thereto; and/or the Cβ region comprises the amino acid sequence set forth in SEQ ID NO: 29, or a sequence of amino acids that has at least 90% sequence identity thereto.

25. The TCR or antigen-binding fragment thereof of any of embodiment 18, 20 and 21, wherein:

the Cα region comprises the amino acid sequence set forth in SEQ ID NO: 14, or a sequence of amino acids that has at least 90% sequence identity thereto; and/or the Cβ region comprises the amino acid sequence set forth in SEQ ID NO: 350, or a sequence of amino acids that has at least 90% sequence identity thereto.

26. The TCR or antigen-binding fragment thereof of any of embodiments 21-25, wherein the introduction of one or more cysteine residues comprises replacement of a non-cysteine residue with a cysteine residue.

27. The TCR or antigen-binding fragment thereof of any of embodiments 21-26, wherein the Cα region comprises a cysteine at a position corresponding to position 48 with numbering as set forth in any of SEQ ID NO: 333-337 or at a position corresponding to position 49 with numbering as set forth in SEQ ID NO: 338 or 341; and/or the Cβ region comprises a cysteine at a position corresponding to position 57 with numbering as set forth in SEQ ID NO: 339 or 340 or at a position corresponding to position 58 with numbering as set forth in SEQ ID NO: 342 or 343.

28. The TCR or antigen-binding fragment thereof of any of embodiments 18, 20, 21 and 24-27, wherein:

a) the alpha chain comprises the amino acid sequence set forth in SEQ ID NOs: 43, 73, 99, 122, 145, 165, 191, or 217, or a sequence of amino acids that has at least 90% sequence identity thereto; and/or the beta chain comprises the amino acid sequence set forth in SEQ ID NOs: 56, 84, 110, 133, 153, 176, 202, or 228, or a sequence of amino acids that has at least 90% sequence identity thereto; or b) the alpha and beta chains comprise the amino acid sequences of SEQ ID NOs: 43 and 56, respectively; the alpha and beta chains comprise the amino acid sequences of SEQ ID NOs: 73 and 84, respectively; the alpha and beta chains comprise the amino acid sequences of SEQ ID NOs: 99 and 110, respectively; the alpha and beta chains comprise the amino acid sequences of SEQ ID NOs: 122 and 133, respectively; the alpha and beta chains comprise the amino acid sequences of SEQ ID NOs: 145 and 153, respectively; the alpha and beta chains comprise the amino acid sequences of SEQ ID NOs: 165 and 176, respectively; the alpha and beta chains comprise the amino acid sequences of SEQ ID NOs: 191 and 202, respectively; or the alpha and beta chains comprise the amino acid sequences of SEQ ID NOs:217 and 228, respectively.

29. The TCR or antigen-binding fragment thereof of any of embodiments 18, 20, 21, 23 and 25-27, wherein:

a) the alpha chain comprises the amino acid sequence set forth in SEQ ID NOs: 43, 73, 99, 122, 145, 165, 191, or 217, or a sequence of amino acids that has at least 90% sequence identity thereto; and/or the beta chain comprises the amino acid sequence set forth in SEQ ID NOs: 359, 370, 371, 372, 373, 374, 375 or 376, or a sequence of amino acids that has at least 90% sequence identity thereto; or b) the alpha and beta chains comprise the amino acid sequences of SEQ ID NOs: 43 and 359, respectively; the alpha and beta chains comprise the amino acid sequences of SEQ ID NOs: 73 and 370, respectively; the alpha and beta chains comprise the amino acid sequences of SEQ ID NOs: 99 and 371, respectively; the alpha and beta chains comprise the amino acid sequences of SEQ ID NOs: 122 and 372, respectively; the alpha and beta chains comprise the amino acid sequences of SEQ ID NOs: 145 and 373, respectively; the alpha and beta chains comprise the amino acid sequences of SEQ ID NOs: 165 and 374, respectively; the alpha and beta chains comprise the amino acid sequences of SEQ ID NOs: 191 and 375, respectively; or the alpha and beta chains comprise the amino acid sequences of SEQ ID NOs:217 and 376, respectively.

30. The TCR or antigen-binding fragment thereof of any of embodiments 1-29, wherein the TCR or antigen-binding fragment comprises:

(i) the alpha and beta chains comprising the amino acid sequences of SEQ ID NOs: 44 and 57, respectively;

(ii) the alpha and beta chains comprising the amino acid sequence set forth in SEQ ID NO:43 and SEQ ID NO:56, respectively; or (iii) an alpha and beta chain that independently exhibit at least 90%, 91%, 92%, 93%, 94%, 95%, 96%, 97%, 98%, 99% or more sequence identity to the alpha and beta chain sequences, respectively, in (i) or to the alpha and beta chain sequences, respectively, in (ii), wherein the alpha chain comprises a CDR-1, a CDR-2, and a CDR-3, comprising the amino acid sequences of SEQ ID NOs: 48, 49, and 50, respectively, and the beta chain comprises a CDR-1, a CDR-2, and a CDR-3, comprising the amino acid sequences of SEQ ID NOs: 61, 62, and 63.

31. The TCR or antigen-binding fragment thereof of any of embodiments 1-30, wherein the TCR or antigen-binding fragment comprises an alpha and beta chain that independently exhibit at least 90%, 91%, 92%, 93%, 94%, 95%, 96%, 97%, 98%, 99% or more sequence identity to the alpha and beta chain sequences comprising the amino acid sequences of SEQ ID NOs: 43 and 56, respectively, wherein the alpha chain comprises a CDR-1, a CDR-2, and a CDR-3, comprising the amino acid sequences of SEQ ID NOs: 48, 49, and 50, respectively, and the beta chain comprises a CDR-1, a CDR-2, and a CDR-3, comprising the amino acid sequences of SEQ ID NOs: 61, 62, and 63.

32. The TCR or antigen-binding fragment thereof of any of embodiments 1-31, wherein the TCR or antigen-binding fragment comprises the alpha and beta chains comprising the amino acid sequences of SEQ ID NOs: 43 and 56, respectively.

33. The TCR or antigen-binding fragment thereof of any of embodiments 1-31, wherein the TCR or antigen-binding fragment comprises the alpha and beta chains comprising the amino acid sequences of SEQ ID NOs: 43 and 359, respectively.

34. The TCR or antigen-binding fragment thereof of any of embodiments 1-29, wherein the TCR or antigen-binding fragment comprises:

(i) the alpha and beta chains comprising the amino acid sequences of SEQ ID NOs: 192 and 203, respectively;

(ii) the alpha and beta chains comprising the amino acid sequence set forth in SEQ ID NO:191 and SEQ ID NO:202, respectively; or (iii) an alpha and beta chain that independently exhibit at least 90%, 91%, 92%, 93%, 94%, 95%, 96%, 97%, 98%, 99% or more sequence identity to the alpha and beta chain sequences, respectively, in (i) or to the alpha and beta chain sequences, respectively, in (ii), wherein the alpha chain comprises a CDR-1, a CDR-2, and a CDR-3, comprising the amino acid sequences of SEQ ID NOs: 196, 197, and 198, respectively, and the beta chain comprises a CDR-1, a CDR-2, and a CDR-3, comprising the amino acid sequences of SEQ ID NOs: 207, 208, and 209, respectively.

35. The TCR or antigen-binding fragment thereof of any of embodiments 1-29 and 34, wherein the TCR or antigen-binding fragment comprises the alpha and beta chains comprising the amino acid sequence set forth in SEQ ID NO: 191 and SEQ ID NO:375.

36. The TCR or antigen-binding fragment thereof of any of embodiments 1-29, wherein the TCR or antigen-binding fragment comprises:

(i) the alpha and beta chains comprising the amino acid sequences of SEQ ID NOs: 218 and 229, respectively;

(ii) the alpha and beta chains comprising the amino acid sequence set forth in SEQ ID NO:217 and SEQ ID NO:228, respectively; or (iii) an alpha and beta chain that independently exhibit at least 90%, 91%, 92%, 93%, 94%, 95%, 96%, 97%, 98%, 99% or more sequence identity to the alpha and beta chain sequences, respectively, in (i) or to the alpha and beta chain sequences, respectively, in (ii), wherein the alpha chain comprises a CDR-1, a CDR-2, and a CDR-3, comprising the amino acid sequences of SEQ ID NOs: 222, 223, and 224, respectively, and the beta chain comprises a CDR-1, a CDR-2, and a CDR-3, comprising the amino acid sequences of SEQ ID NOs: 233, 234, and 235, respectively.

37. The TCR or antigen-binding fragment thereof of any of embodiments 1-29 and 36, wherein the TCR or antigen-binding fragment comprises the alpha and beta chains comprising the amino acid sequences of SEQ ID NOs: 217 and 376, respectively.

38. A T cell receptor (TCR) or antigen-binding fragment thereof, comprising an alpha chain comprising a variable alpha (Vα) region and a beta chain comprising a variable beta (Vβ) region, wherein:

the Vα region comprises the amino acid sequence set forth in any of SEQ ID NO: 247 or an amino acid sequence that has at least 90%, 91%, 92%, 93%, 94%, 95%, 96%, 97%, 98%, or 99% sequence identity thereto; and/or the Vβ region comprises the amino acid sequence set forth in any of SEQ ID NOs: 258 or an amino acid sequence that has at least 90%, 91%, 92%, 93%, 94%, 95%, 96%, 97%, 98%, or 99% sequence identity thereto.

39. A T cell receptor (TCR) or antigen-binding fragment thereof, comprising an alpha chain comprising a variable alpha (Vα) region and a beta chain comprising a variable beta (Vβ) region, wherein:

the Vα region comprises the amino acid sequence set forth in any of SEQ ID NO: 247 or an amino acid sequence that has at least 90%, 91%, 92%, 93%, 94%, 95%, 96%, 97%, 98%, or 99% sequence identity thereto; and the Vβ region comprises the amino acid sequence set forth in any of SEQ ID NOs: 258 or an amino acid sequence that has at least 90%, 91%, 92%, 93%, 94%, 95%, 96%, 97%, 98%, or 99% sequence identity thereto.

40. The TCR or antigen-binding fragment thereof of embodiment 38 or embodiment 39, wherein:

the Vα region comprises the amino acid sequence set forth in any of SEQ ID NO: 247 or an amino acid sequence that has at least 90%, 91%, 92%, 93%, 94%, 95%, 96%, 97%, 98%, or 99% sequence identity thereto; and/or the Vβ region comprises the amino acid sequence set forth in any of SEQ ID NOs: 258 or an amino acid sequence that has at least 93%, 94%, 95%, 96%, 97%, 98%, or 99% sequence identity thereto.

41. The TCR or antigen-binding fragment thereof of any of embodiments 38-40, wherein the TCR or antigen-binding fragment thereof binds to or recognizes a peptide epitope of human papillomavirus (HPV) 16 E6 in the context of an MHC molecule, the peptide epitope is or comprises E6(29-38) TIHDIILECV (SEQ ID NO: 268).

42. The TCR or antigen-binding fragment of any of embodiments 38-41, wherein:

the Vα region comprises a complementarity determining region 3 (CDR-3) comprising an amino acid sequence set forth in SEQ ID NO: 250, or a CDR3 contained within the amino acid sequence set forth in SEQ ID NO: 247; and/or the Vβ region comprises a complementarity determining region 3 (CDR-3) comprising an amino acid sequence set forth in SEQ ID NO: 261, or a CDR3 contained within the amino acid sequence set forth in SEQ ID NO: 258.

43. The TCR or antigen-binding fragment of embodiment 42, wherein the Vα region comprises:

a complementarity determining region 1 (CDR-1) comprising an amino acid sequence set forth in SEQ ID NO: 248 or a CDR-1 contained within the amino acid sequence set forth in SEQ ID NO: 247; and/or a complementarity determining region 2 (CDR-2) comprising an amino acid sequence set forth in SEQ ID NO: 249 or a CDR-2 contained within the amino acid sequence set forth in SEQ ID NO: 247.

44. The TCR or antigen-binding fragment of embodiment 42 or embodiment 43, wherein the Vβ region comprises:

a complementarity determining region 1 (CDR-1) comprising an amino acid sequence set forth in SEQ ID NO: 259 or a CDR-1 contained within the amino acid sequence set forth in SEQ ID NO: 258; and/or a complementarity determining region 2 (CDR-2) comprising an amino acid sequence set forth in SEQ ID NO: 260 or a CDR-2 contained within the amino acid sequence set forth in SEQ ID NO: 258.

45. The TCR or antigen-binding fragment thereof of any of embodiments 38-44, wherein:

the Vα region comprises: a complementarity determining region 1 (CDR-1) comprising an amino acid sequence set forth in SEQ ID NO: 248; a complementarity determining region 2 (CDR-2) comprising an amino acid sequence set forth in SEQ ID NO: 249; and/or a complementarity determining region 3 (CDR-3) comprising an amino acid sequence set forth in SEQ ID NO: 250; and/or the Vβ region comprises: a complementarity determining region 1 (CDR-1) comprising an amino acid sequence set forth in SEQ ID NO: 259; a complementarity determining region 2 (CDR-2) comprising an amino acid sequence set forth in SEQ ID NO: 260; and/or a complementarity determining region 3 (CDR-3) comprising an amino acid sequence set forth in SEQ ID NO: 261.

46. The TCR or antigen-binding fragment thereof of any of embodiments 38-45, wherein:

the Vα region comprises a complementarity determining region 1 (CDR-1), a CDR-2, and a CDR-3, respectively comprising the CDR-1, the CDR-2, and the CDR-3 amino acid sequences contained within a Vα region amino acid sequence set forth in SEQ ID NO: 247; and/or the Vβ region comprises a complementarity determining region 1 (CDR-1), a CDR-2, and a CDR-3, respectively comprising the CDR-1, the CDR-2, and the CDR-3 amino acid sequences contained within a Vβ region amino acid sequence set forth in SEQ ID NO: 258.

47. The TCR or antigen-binding fragment thereof of any of embodiments 38-46, wherein:

the Vα region comprises a CDR-1, a CDR-2, and a CDR-3, comprising the amino acid sequences of SEQ ID NOs: 248, 249, and 250, respectively, and the Vβ region comprises a CDR-1, a CDR-2, and a CDR-3, comprising the amino acid sequences of SEQ ID NOs: 259, 260, and 261, respectively.

48. The TCR or antigen-binding fragment thereof of any of embodiments 38-47, wherein the Vα and Vβ regions comprise the amino acid sequences of SEQ ID NOs: 247 and 258, respectively, or an amino acid sequence that has at least 90%, 91%, 92%, 93%, 94%, 95%, 96%, 97%, 98%, or 99% sequence identity thereto.

49. The TCR or antigen-binding fragment thereof of any of embodiments 38-48, wherein: the Vα and Vβ regions comprise the amino acid sequences of SEQ ID NOs: 247 and 258, respectively.

50. The TCR or antigen-binding fragment thereof of any of embodiments 38-49, wherein the alpha chain further comprises an alpha constant (Cα) region and/or the beta chain further comprises a beta constant (Cβ) region.

51. The TCR or antigen-binding fragment thereof of embodiment 50, wherein the Cα and Cβ regions are mouse constant regions.

52. The TCR or antigen-binding fragment thereof of embodiment 50, wherein the Cα and Cβ regions are human constant regions.

53. The TCR or antigen-binding fragment thereof of any of embodiments 50-52, wherein the Cα and/or Cβ regions comprise introduction of one or more cysteine residues that are capable of forming one or more non-native disulfide bridges between the alpha chain and beta chain.

54. The TCR or antigen-binding fragment thereof of any of embodiment 50, 51 and 53, wherein:

the Cα region comprises the amino acid sequence set forth in SEQ ID NO: 15, or a sequence of amino acids that has at least 90% sequence identity thereto; and/or the Cβ region comprises the amino acid sequence set forth in SEQ ID NO: 30, or a sequence of amino acids that has at least 90% sequence identity thereto.

55. The TCR or antigen-binding fragment thereof of any of embodiments 50, 51, 53 and 54, wherein:
a) the alpha chain comprises the amino acid sequence set forth in SEQ ID NOs: 244, or a sequence of amino acids that has at least 90%, 91%, 92%, 93%, 94%, 95%, 96%, 97%, 98%, 99% sequence identity thereto; and/or the beta chain comprises the amino acid sequence set forth in SEQ ID NOs: 255, or a sequence of amino acids that has at least 90% sequence identity thereto, optionally wherein the alpha chain comprises a CDR-1, a CDR-2, and a CDR-3, comprising the amino acid sequences of SEQ ID NOs: 248, 249, and 250, respectively, and the beta chain comprises a CDR-1, a CDR-2, and a CDR-3, comprising the amino acid sequences of SEQ ID NOs: 259, 260, and 261, respectively; or
b) the alpha and beta chains comprise the amino acid sequences of SEQ ID NOs: 244 and 255, respectively.

56. The TCR or antigen-binding fragment thereof of any of embodiment 50, 52 and 53, wherein:
the Cα region comprises the amino acid sequence set forth in SEQ ID NO: 14, or a sequence of amino acids that has at least 90% sequence identity thereto; and/or
the Cβ region comprises the amino acid sequence set forth in SEQ ID NO: 29, or a sequence of amino acids that has at least 90% sequence identity thereto.

57. The TCR or antigen-binding fragment thereof of any of embodiment 50, 52 and 53, wherein:
the Cα region comprises the amino acid sequence set forth in SEQ ID NO: 14, or a sequence of amino acids that has at least 90% sequence identity thereto; and/or
the Cβ region comprises the amino acid sequence set forth in SEQ ID NO:350, or a sequence of amino acids that has at least 90% sequence identity thereto.

58. The TCR or antigen-binding fragment thereof of any of embodiments 53-57, wherein the introduction of one or more cysteine residues comprises replacement of a non-cysteine residue with a cysteine residue.

59. The TCR or antigen-binding fragment thereof of any of embodiments 53-58, the Cα region comprises a cysteine at a position corresponding to position 48 with numbering as set forth in any of SEQ ID NO: 333-337 or at a position corresponding to position 49 with numbering as set forth in SEQ ID NO: 338 or 341; and/or the Cβ region comprises a cysteine at a position corresponding to position 57 with numbering as set forth in SEQ ID NO: 339 or 340 or at a position corresponding to position 58 with numbering as set forth in SEQ ID NO: 342 or 343.

60. The TCR or antigen-binding fragment thereof of any of embodiments 38-59, wherein:
a) the alpha chain comprises the amino acid sequence set forth in SEQ ID NOs: 243, or a sequence of amino acids that has at least 90%, 91%, 92%, 93%, 94%, 95%, 96%, 97%, 98%, 99% sequence identity thereto; and/or the beta chain comprises the amino acid sequence set forth in SEQ ID NOs: 254, or a sequence of amino acids that has at least 90% sequence identity thereto, optionally wherein the alpha chain comprises a CDR-1, a CDR-2, and a CDR-3, comprising the amino acid sequences of SEQ ID NOs: 248, 249, and 250, respectively, and the beta chain comprises a CDR-1, a CDR-2, and a CDR-3, comprising the amino acid sequences of SEQ ID NOs: 259, 260, and 261, respectively; or
b) the alpha and beta chains comprise the amino acid sequences of SEQ ID NOs: 243 and 254, respectively.

61. The TCR or antigen-binding fragment thereof of any of embodiments 38-59, wherein:
a) the alpha chain comprises the amino acid sequence set forth in SEQ ID NOs: 243, or a sequence of amino acids that has at least 90%, 91%, 92%, 93%, 94%, 95%, 96%, 97%, 98%, 99% sequence identity thereto; and/or the beta chain comprises the amino acid sequence set forth in SEQ ID NOs: 377, or a sequence of amino acids that has at least 90% sequence identity thereto, optionally wherein the alpha chain comprises a CDR-1, a CDR-2, and a CDR-3, comprising the amino acid sequences of SEQ ID NOs: 248, 249, and 250, respectively, and the beta chain comprises a CDR-1, a CDR-2, and a CDR-3, comprising the amino acid sequences of SEQ ID NOs: 259, 260, and 261, respectively; or
b) the alpha and beta chains comprise the amino acid sequences of SEQ ID NOs: 243 and 377, respectively.

62. A T cell receptor (TCR) or antigen-binding fragment thereof, comprising an alpha chain comprising a variable alpha (Vα) region and a beta chain comprising a variable beta (Vβ) region, wherein:
the Vα region comprises the amino acid sequence set forth in any of SEQ ID NO: 9 or an amino acid sequence that has at least 90%, 91%, 92%, 93%, 94%, 95%, 96%, 97%, 98%, or 99% sequence identity thereto; and/or
the Vβ region comprises the amino acid sequence set forth in any of SEQ ID NOs: 24 or an amino acid sequence that has at least 90%, 91%, 92%, 93%, 94%, 95%, 96%, 97%, 98%, or 99% sequence identity thereto.

63. A T cell receptor (TCR) or antigen-binding fragment thereof, comprising an alpha chain comprising a variable alpha (Va) region and a beta chain comprising a variable beta (Vβ) region, wherein:
the Vα region comprises the amino acid sequence set forth in any of SEQ ID NO: 9 or an amino acid sequence that has at least 90%, 91%, 92%, 93%, 94%, 95%, 96%, 97%, 98%, or 99% sequence identity thereto; and
the Vβ region comprises the amino acid sequence set forth in any of SEQ ID NOs: 24 or an amino acid sequence that has at least 90%, 91%, 92%, 93%, 94%, 95%, 96%, 97%, 98%, or 99% sequence identity thereto.

64. The TCR or antigen-binding fragment thereof of embodiment 62 or embodiment 63, wherein:
the Vα region comprises the amino acid sequence set forth in any of SEQ ID NO: 9 or an amino acid sequence that has at least 90%, 91%, 92%, 93%, 94%, 95%, 96%, 97%, 98%, or 99% sequence identity thereto; and/or
the Vβ region comprises the amino acid sequence set forth in any of SEQ ID NOs: 24 or an amino acid sequence that has at least 93%, 94%, 95%, 96%, 97%, 98%, or 99% sequence identity thereto.

65. The TCR or antigen-binding fragment thereof of any of embodiments 62-64, wherein the TCR or antigen-binding fragment thereof, when expressed on the surface of a T cell, stimulates cytotoxic activity against a target cancer cell, optionally wherein the target cancer cell contains HPV DNA sequences or expresses HPV 16 and/or optionally wherein the target cancer cell is SCC152.

66. The TCR or antigen-binding fragment of any of embodiments 62-65, wherein:
the Vα region comprises a complementarity determining region 3 (CDR-3) comprising an amino acid sequence set forth in SEQ ID NO: 12, or a CDR3 contained within the amino acid sequence set forth in SEQ ID NO: 9; and/or
the Vβ region comprises a complementarity determining region 3 (CDR-3) comprising an amino acid sequence set forth in SEQ ID NO: 27, or a CDR3 contained within the amino acid sequence set forth in SEQ ID NO: 24.

67. The TCR or antigen-binding fragment of embodiment 66, wherein the Vα region comprises:
a complementarity determining region 1 (CDR-1) comprising an amino acid sequence set forth in SEQ ID NO: 10 or a CDR-1 contained within the amino acid sequence set forth in SEQ ID NO: 9; and/or a complementarity determining region 2 (CDR-2) comprising an amino acid sequence set forth in SEQ ID NO: 11 or a CDR-2 contained within the amino acid sequence set forth in SEQ ID NO: 9.

68. The TCR or antigen-binding fragment of embodiment 66 or embodiment 67, wherein the Vβ region comprises:

a complementarity determining region 1 (CDR-1) comprising an amino acid sequence set forth in SEQ ID NO: 25 or a CDR-1 contained within the amino acid sequence set forth in SEQ ID NO: 24; and/or a complementarity determining region 2 (CDR-2) comprising an amino acid sequence set forth in SEQ ID NO: 26 or a CDR-2 contained within the amino acid sequence set forth in SEQ ID NO: 24.

69. The TCR or antigen-binding fragment thereof of any of embodiments 62-68, wherein:

the Vα region comprises: a complementarity determining region 1 (CDR-1) comprising an amino acid sequence set forth in SEQ ID NO: 10; a complementarity determining region 2 (CDR-2) comprising an amino acid sequence set forth in SEQ ID NO: 11; and/or a complementarity determining region 3 (CDR-3) comprising an amino acid sequence set forth in SEQ ID NO: 12; and/or the Vβ region comprises: a complementarity determining region 1 (CDR-1) comprising an amino acid sequence set forth in SEQ ID NO: 25; a complementarity determining region 2 (CDR-2) comprising an amino acid sequence set forth in SEQ ID NO: 26; and/or a complementarity determining region 3 (CDR-3) comprising an amino acid sequence set forth in SEQ ID NO: 27.

70. The TCR or antigen-binding fragment thereof of any of embodiments 62-69, wherein:

the Vα region comprises a complementarity determining region 1 (CDR-1), a CDR-2, and a CDR-3, respectively comprising the CDR-1, the CDR-2, and the CDR-3 amino acid sequences contained within a Vα region amino acid sequence set forth in SEQ ID NO: 9; and/or the Vβ region comprises a complementarity determining region 1 (CDR-1), a CDR-2, and a CDR-3, respectively comprising the CDR-1, the CDR-2, and the CDR-3 amino acid sequences contained within a Vβ region amino acid sequence set forth in SEQ ID NO: 24.

71. The TCR or antigen-binding fragment thereof of any of embodiments 62-70, wherein:

the Vα region comprises a CDR-1, a CDR-2, and a CDR-3, comprising the amino acid sequences of SEQ ID NOs: 10, 11, and 12, respectively, and the Vβ region comprises a CDR-1, a CDR-2, and a CDR-3, comprising the amino acid sequences of SEQ ID NOs: 25, 26, and 27, respectively.

72. The TCR or antigen-binding fragment thereof of any of embodiments 62-71, wherein the Vα and Vβ regions comprise the amino acid sequences of SEQ ID NOs: 9 and 24, respectively, or an amino acid sequence that has at least 90%, 91%, 92%, 93%, 94%, 95%, 96%, 97%, 98%, or 99% sequence identity thereto.

73. The TCR or antigen-binding fragment thereof of any of embodiments 62-72, wherein the Vα and Vβ regions comprise the amino acid sequences of SEQ ID NOs: 9 and 24, respectively.

74. The TCR or antigen-binding fragment thereof of any of embodiments 62-73, wherein the alpha chain further comprises an alpha constant (Cα) region and/or the beta chain further comprises a beta constant (Cβ) region.

75. The TCR or antigen-binding fragment thereof of embodiment 74, wherein the Cα and Cβ regions are mouse constant regions.

76. The TCR or antigen-binding fragment thereof of embodiment 74, wherein the Cα and Cβ regions are human constant regions.

77. The TCR or antigen-binding fragment thereof of any of embodiments 74-76, wherein the Cα and/or Cβ regions comprise introduction of one or more cysteine residues that are capable of forming one or more non-native disulfide bridges between the alpha chain and beta chain.

78. The TCR or antigen-binding fragment thereof of any of embodiment 74, 75 and 77, wherein:

the Cα region comprises the amino acid sequence set forth in SEQ ID NO: 15, or a sequence of amino acids that has at least 90% sequence identity thereto; and/or the Cβ region comprises the amino acid sequence set forth in SEQ ID NO: 30, or a sequence of amino acids that has at least 90% sequence identity thereto.

79. The TCR or antigen-binding fragment thereof of any of embodiments 74, 75, 77 and 78, wherein:

a) the alpha chain comprises the amino acid sequence set forth in SEQ ID NOs: 6, or a sequence of amino acids that has at least 90%, 91%, 92%, 93%, 94%, 95%, 96%, 97%, 98%, 99% sequence identity thereto; and/or the beta chain comprises the amino acid sequence set forth in SEQ ID NOs: 21, or a sequence of amino acids that has at least 90% sequence identity thereto, optionally wherein the alpha chain comprises a CDR-1, a CDR-2, and a CDR-3, comprising the amino acid sequences of SEQ ID NOs: 10, 11, and 12, respectively, and the beta chain comprises a CDR-1, a CDR-2, and a CDR-3, comprising the amino acid sequences of SEQ ID NOs: 25, 26, and 27, respectively; or b) the alpha and beta chains comprise the amino acid sequences of SEQ ID NOs: 6 and 21, respectively.

80. The TCR or antigen-binding fragment thereof of any of embodiment 74, 76 and 77, wherein:

the Cα region comprises the amino acid sequence set forth in SEQ ID NO: 14, or a sequence of amino acids that has at least 90% sequence identity thereto; and/or the Cβ region comprises the amino acid sequence set forth in SEQ ID NO: 29, or a sequence of amino acids that has at least 90% sequence identity thereto.

81. The TCR or antigen-binding fragment thereof of any of embodiment 74, 76 and 77, wherein:

the Cα region comprises the amino acid sequence set forth in SEQ ID NO: 14, or a sequence of amino acids that has at least 90% sequence identity thereto; and/or the Cβ region comprises the amino acid sequence set forth in SEQ ID NO: 350, or a sequence of amino acids that has at least 90% sequence identity thereto.

82. The TCR or antigen-binding fragment thereof of any of embodiments 77-81, wherein the introduction of one or more cysteine residues comprises replacement of a non-cysteine residue with a cysteine residue.

83. The TCR or antigen-binding fragment thereof of any of embodiments 81-88, the Cα region comprises a cysteine at a position corresponding to position 48 with numbering as set forth in any of SEQ ID NO: 333-337 or at a position corresponding to position 49 with numbering as set forth in SEQ ID NO: 338 or 341; and/or the Cβ region comprises a cysteine at a position corresponding to position 57 with numbering as set forth in SEQ ID NO: 339 or 340 or at a position corresponding to position 58 with numbering as set forth in SEQ ID NO: 342 or 343.

84. The TCR or antigen-binding fragment thereof of any of embodiments 62-83, wherein:
  a) the alpha chain comprises the amino acid sequence set forth in SEQ ID NOs: 5, or a sequence of amino acids that has at least 90%, 91%, 92%, 93%, 94%, 95%, 96%, 97%, 98%, 99% sequence identity thereto; and/or the beta chain comprises the amino acid sequence set forth in SEQ ID NOs: 20, or a sequence of amino acids that has at least 90% sequence identity thereto, optionally wherein the alpha chain comprises a CDR-1, a CDR-2, and a CDR-3, comprising the amino acid sequences of SEQ ID NOs: 10, 11, and 12, respectively, and the beta chain comprises a CDR-1, a CDR-2, and a CDR-3, comprising the amino acid sequences of SEQ ID NOs: 25, 26, and 27, respectively; or
  b) the alpha and beta chains comprise the amino acid sequences of SEQ ID NOs: 5 and 20, respectively.

85. The TCR or antigen-binding fragment thereof of any of embodiments 62-83, wherein:
  a) the alpha chain comprises the amino acid sequence set forth in SEQ ID NOs: 5, or a sequence of amino acids that has at least 90%, 91%, 92%, 93%, 94%, 95%, 96%, 97%, 98%, 99% sequence identity thereto; and/or the beta chain comprises the amino acid sequence set forth in SEQ ID NOs: 369, or a sequence of amino acids that has at least 90% sequence identity thereto, optionally wherein the alpha chain comprises a CDR-1, a CDR-2, and a CDR-3, comprising the amino acid sequences of SEQ ID NOs: 10, 11, and 12, respectively, and the beta chain comprises a CDR-1, a CDR-2, and a CDR-3, comprising the amino acid sequences of SEQ ID NOs: 25, 26, and 27, respectively; or
  b) the alpha and beta chains comprise the amino acid sequences of SEQ ID NOs: 5 and 369, respectively.

86. The TCR or antigen-binding fragment thereof of any of embodiments 1-85, wherein the TCR or antigen-binding fragment thereof is encoded by a nucleotide sequence that has been codon-optimized.

87. The TCR or antigen-binding fragment thereof of any of embodiments 1-86, wherein the alpha and/or beta chain further comprises a signal peptide.

88. The TCR or antigen-binding fragment thereof of any of embodiments 1-87, that is isolated or purified or is recombinant.

89. The TCR or antigen-binding fragment thereof of any of embodiments 1-88, that is human.

90. The TCR or antigen-binding fragment thereof of any of embodiments 1-89, that is monoclonal.

91. The TCR or antigen-binding fragment thereof of any of embodiments 1-90, wherein the TCR or antigen-binding fragment thereof is single chain.

92. The TCR or antigen-binding fragment thereof of any of embodiments 1-91, wherein the TCR or antigen-binding fragment thereof comprises two chains.

93. The TCR or antigen-binding fragment thereof of any of embodiments 1-92, wherein the antigen-specificity is at least partially CD8-independent.

94. The TCR or antigen-binding fragment of any of embodiments 7-37 and 41-61 wherein the MHC molecule is an HLA-A2 molecule.

95. A nucleic acid molecule encoding the TCR or antigen-binding fragment thereof of any of embodiments 1-94, or an alpha or beta chain thereof.

96. The nucleic acid molecule of embodiment 95, wherein the nucleotide sequence is codon-optimized.

97. The nucleic acid molecule of embodiment 95 or embodiment 96, wherein the nucleotide sequence encoding the alpha chain and the nucleotide sequence encoding the beta chain are separated by a peptide sequence that causes ribosome skipping.

98. The nucleic acid molecule of embodiment 97, wherein the peptide that causes ribosome skipping is a P2A or T2A peptide and/or comprises the sequence of amino acids set forth in SEQ ID NO: 32 or 302.

99. The nucleic acid of any of embodiments 95-98, wherein the nucleic acid is synthetic.

100. The nucleic acid of any of embodiments 95-99, wherein the nucleic acid is cDNA.

101. A vector comprising the nucleic acid of any of embodiments 95-100.

102. The vector of embodiment 101, wherein the vector is an expression vector.

103. The vector of embodiment 101 or embodiment 102, wherein the vector is a viral vector.

104. The vector of embodiment 103, wherein the viral vector is a retroviral vector.

105. The vector of embodiment 103 or embodiment 104, wherein the viral vector is a lentiviral vector.

106. The vector of embodiment 105, wherein the lentiviral vector is derived from HIV-1.

107. An engineered cell comprising the nucleic acid molecule of any of embodiments 95-100 or vector of any of embodiments 101-106.

108. An engineered cell, comprising the TCR or antigen-binding fragment thereof of any of embodiments 1-94.

109. The engineered cell of embodiment 107 or embodiment 108, wherein the TCR or antigen-binding fragment thereof is heterologous to the cell.

110. The engineered cell of any of embodiments 107-109, wherein the engineered cell is a cell line.

111. The engineered cell of any of embodiments 107-110, wherein the engineered cell is a primary cell obtained from a subject.

112. The engineered cell of embodiment 111, wherein the subject is a mammalian subject.

113. The engineered cell of embodiment 111 or embodiment 112, wherein the subject is a human.

114. The engineered cell of any of embodiments 111-113, wherein the engineered cell is a T cell.

115. The engineered cell of embodiment 114, wherein the T cell is CD8+.

116. The engineered cell of embodiment 114, wherein the T cell is CD4+.

117. The engineered cell of any of embodiments 107-116, wherein:
  (a) the TCR or antigen-binding fragment thereof comprises a human alpha constant (Cα) region and a human beta constant (Cβ) region and the engineered cell comprises or expresses an endogenous human TCR;
  (b) the engineered cell comprises or expresses an endogenous human TCR alpha chain protein and/or an endogenous TCR beta chain protein; and/or
  (c) the engineered cell comprises a nucleotide sequence encoding a full endogenous human TCR alpha chain and/or a full endogenous human TCR beta chain.

118. The engineered cell of any of embodiments 107-117, wherein the Vα region of the TCR or antigen-binding fragment thereof comprises a CDR-1, a CDR-2, and a CDR-3, comprising the amino acid sequences of SEQ ID NOs: 48, 49, and 50, respectively, and the Vβ region of the TCR or antigen-binding fragment thereof comprises a CDR-1, a CDR-2, and a CDR-3, comprising the amino acid sequences of SEQ ID NOs: 61, 62, and 63

119. The engineered cell of any of embodiments 107-118, wherein the Vα region of the TCR or antigen-binding fragment thereof comprises the amino acid sequence set forth in SEQ ID NO: 47 or an amino acid sequence that has at least 90%, 91%, 92%, 93%, 94%, 95%, 96%, 97%, 98%, or 99% sequence identity thereto; and the Vβ region comprises the amino acid sequence set forth in SEQ ID NOs: 60, or an amino acid sequence that has at least 90%, 91%, 92%, 93%, 94%, 95%, 96%, 97%, 98%, or 99% sequence identity thereto.

120. The engineered cell of any of embodiments 107-119, wherein the Vα and Vβ regions of the TCR or antigen-binding fragment thereof comprise the amino acid sequences of SEQ ID NOs: 47 and 60, respectively.

121. The engineered cell of any of embodiments 107-120, wherein:
the Cα region of the TCR or antigen-binding fragment thereof comprises the amino acid sequence set forth in SEQ ID NO: 14, or a sequence of amino acids that has at least 90% sequence identity thereto; and/or
the Cβ region of the TCR or antigen-binding fragment thereof comprises the amino acid sequence set forth in SEQ ID NO: 350, or a sequence of amino acids that has at least 90% sequence identity thereto.

122. The engineered cell of any of embodiments 107-121, comprising a genetic disruption of a T cell receptor alpha constant (TRAC) gene and/or a T cell receptor beta constant (TRBC) gene.

123. The engineered cell of embodiment 122, wherein the TRBC gene is one or both of a T cell receptor beta constant 1 (TRBC1) or T cell receptor beta constant 2 (TRBC2) gene.

124. A method for producing a cell of any of embodiments 107-123, comprising introducing a vector of any of embodiments 84-89 into a cell in vitro or ex vivo.

125. The method of embodiment 124, wherein the vector is a viral vector and the introducing is carried out by transduction.

126. The method of embodiment 124 or embodiment 125, further comprising introducing into the cell one or more agent, wherein each of the one or more agent is independently capable of inducing a genetic disruption of a T cell receptor alpha constant (TRAC) gene and/or a T cell receptor beta constant (TRBC) gene.

127. The method of any of embodiment 126, wherein the one or more agent capable of inducing a genetic disruption comprises a DNA binding protein or DNA-binding nucleic acid that specifically binds to or hybridizes to the target site.

128. The method of embodiment 127, wherein the one or more agent capable of inducing a genetic disruption comprises (a) a fusion protein comprising a DNA-targeting protein and a nuclease or (b) an RNA-guided nuclease.

129. The method of embodiment 128, wherein the DNA-targeting protein or RNA-guided nuclease comprises a zinc finger protein (ZFP), a TAL protein, or a clustered regularly interspaced short palindromic nucleic acid (CRISPR)-associated nuclease (Cas) specific for a target site within the TRAC and/or TRBC gene.

130. The method of embodiment 129, wherein the one or more agent comprises a zinc finger nuclease (ZFN), a TAL-effector nuclease (TALEN), or and a CRISPR-Cas9 combination that specifically binds to, recognizes, or hybridizes to the target site.

131. The method of embodiment 129 or embodiment 130, wherein the each of the one or more agent comprises a guide RNA (gRNA) having a targeting domain that is complementary to the at least one target site.

132. The method of embodiment 131, wherein the one or more agent is introduced as a ribonucleoprotein (RNP) complex comprising the gRNA and a Cas9 protein.

133. The method of embodiment 132, wherein the RNP is introduced via electroporation, particle gun, calcium phosphate transfection, cell compression or squeezing.

134. The method of embodiment 132 or embodiment 133, wherein the RNP is introduced via electroporation.

135. The method of embodiment 131, wherein the one or more agent is introduced as one or more polynucleotide encoding the gRNA and/or a Cas9 protein.

136. An engineered cell, comprising a recombinant human TCR comprising a human alpha constant (Cα) region and a human beta constant (Cβ) region, and the engineered cell comprises or expresses an endogenous human TCR.

137. The engineered cell of embodiment 136, wherein the recombinant human TCR comprises a Vα region comprising a CDR-1, a CDR-2, and a CDR-3, comprising the amino acid sequences of SEQ ID NOs: 48, 49, and 50, respectively, and a Vβ region comprising a CDR-1, a CDR-2, and a CDR-3, comprising the amino acid sequences of SEQ ID NOs: 61, 62, and 63.

138. The engineered cell of embodiment 136 or embodiment 137, wherein the recombinant human TCR comprises a Vα region comprising the amino acid sequence set forth in SEQ ID NO: 47 or an amino acid sequence that has at least 90%, 91%, 92%, 93%, 94%, 95%, 96%, 97%, 98%, or 99% sequence identity thereto; and a Vβ region comprising the amino acid sequence set forth in SEQ ID NOs: 60, or an amino acid sequence that has at least 90%, 91%, 92%, 93%, 94%, 95%, 96%, 97%, 98%, or 99% sequence identity thereto.

139. The engineered cell of any of embodiments 136-138, wherein the recombinant human TCR comprises a Vα region and a Vβ region comprising the amino acid sequences of SEQ ID NOs: 47 and 60, respectively.

140. The engineered cell of any of embodiments 136-139, wherein the recombinant human TCR comprises a Cα region comprising the amino acid sequence set forth in SEQ ID NO: 14, or a sequence of amino acids that has at least 90% sequence identity thereto; and/or a Cβ region comprising the amino acid sequence set forth in SEQ ID NO: 350, or a sequence of amino acids that has at least 90% sequence identity thereto.

141. A method for producing the engineered cell of any of embodiments 107-123 and 136-140, comprising introducing a vector of any of embodiments 108-113 into a cell in vitro or ex vivo.

142. The method of embodiment 141, wherein the vector is a viral vector and the introducing is carried out by transduction.

143. A composition comprising engineered cells of any of embodiments 107-123 and 136-140.

144. The composition of embodiment 143, wherein the engineered cells comprise CD4+ and/or CD8+ T cells.

145. The composition of embodiment 144 or embodiment 145, wherein the engineered cells comprise CD4+ and CD8+ T cells.

146. A composition, comprising an engineered CD8+ cell of embodiment 115 and an engineered CD4+ cell of embodiment 116.

147. The composition of any of embodiments 143-146, wherein the TCR or antigen-binding fragment thereof binds to or recognizes a peptide epitope of HPV 16 in the context of an MHC molecule that is at least partially CD8-independent.

148. The composition of any of embodiments 143-147, wherein the CD8+ cell and CD4+ cell are engineered with the same TCR or antigen-binding fragment thereof and/or are each engineered with a TCR or antigen-binding fragment thereof that binds to or recognizes the same peptide epitope of HPV 16 in the context of an MHC molecule.

149. The composition of any of embodiments 143-148, further comprising a pharmaceutically acceptable excipient.

150. A method of treatment, comprising administering the engineered cell of any of embodiments 107-123 and 136-140 to a subject having a disease or disorder associated with HPV.

151. A method of treatment, comprising administering the composition of any of embodiments 143-149 to a subject having a disease or disorder associated with HPV.

152. The method of embodiment 150 or embodiment 151, wherein the disease or disorder is associated with HPV16.

153. The method of any of embodiments 150-152, wherein the disease or disorder is cancer.

154. A method of treatment, comprising administering the engineered cell of any of embodiments 107-123 and 136-140 to a subject having a cancer.

155. A method of treatment, comprising administering the composition of any of embodiments 143-149 to a subject having a cancer.

156. The method of any of embodiments 151-155, wherein the subject is a human.

157. A composition of any of embodiments 143-149 for use in treating a disease or disorder associated with HPV in a subject.

158. Use of a composition of any of embodiments 143-149 for the manufacture of a medicament for treating a disease or disorder associated with HPV in a subject.

159. The composition of embodiment 157 or use of embodiment 158, wherein the disease or disorder is associated with HPV16.

160. The composition or use of any of embodiments 157-159, wherein the disease or disorder is cancer.

161. A composition of any of embodiments 143-149 for use in treating a cancer in a subject.

162. Use of a composition of any of embodiments 143-149 for the manufacture of a medicament for treating a cancer in a subject.

163. The composition or use of any of embodiments 157-162, wherein the subject is a human.

IX. EXAMPLES

The following examples are included for illustrative purposes only and are not intended to limit the scope of the invention.

Example 1: Screening and Selection of HPV-16 E6 and E7 Epitope-Specific T Cell Receptors from Donors A screening process using autologous dendritic and T cells was performed to generate antigen-specific T cell receptors (TCRs) that specifically bound to human papillomavirus 16 (HPV16) E6(29-38) or E7(11-19) peptide presented on MHC-I molecules and survived and/or were enriched over time, following multiple rounds of antigen-stimulation. Clonal T cell lines were generated and assessed for binding to peptide-MHC tetramers and cytolytic activity. The sequences of individual paired TCR alpha and beta chains in clonal T cell lines with binding or functional activity observed were then determined on a single-cell basis, using high-throughput paired TCR sequencing.

A. Generation and Cloning of Human HPV-Specific T Cells and TCRs

Briefly, peptide-pulsed antigen-presenting cells were generated from peripheral blood mononuclear cells (PBMCs). Specifically, peptide-pulsed HLA:A02:01APCs were generated with HPV 16 E6(29-38) peptide (TIHDIILECV; SEQ ID NO:268) or E7(11-19) peptide (YMLDLQPET; SEQ ID NO:271). Autologous CD8+ T cells from normal human donors (or, in the case of identified TCR designated TCR 56 and TCR 65, donors with HPV+ head and neck cancer) were incubated over multiple rounds with the peptide-pulsed cells, and selections were carried out based on binding to peptide-loaded autologous MHC tetramers. Generally, cells were subjected to two rounds of stimulation, in the presence of peptide-pulsed cells (with a peptide concentration of 100 ng/mL maintained over the two rounds).

Following the two rounds of stimulation, cells were sorted by flow cytometry into populations positive and negative, respectively, for binding to peptide-MHC tetramers containing the appropriate tetramer. Following the repeated stimulations, populations of cells staining positive for peptide-loaded autologous MHC tetramers were identified by flow cytometry.

B. Determination of Sequences

Cell populations selected above based on tetramer binding were subject to high-throughput single-cell sequencing for TCR alpha and beta chain pairs. High throughput single cell TCR sequencing was performed as generally described in published PCT patent applications, publication numbers WO2012/048340, WO2012/048341 and WO2016/044227. The sequencing methods employed single-cell droplets and sample and molecular barcodes, to identify individual pairs of TCR alpha and beta chain sequences at a single-cell level, for each of a large number (e.g., millions) of single cells present in a single starting composition, and to assess abundance of each TCR pair in various populations assessed. The ability to identify and quantify TCR pairs at a single-cell level permitted the assessment of the frequency of each of various TCR pairs in each of the individual positive and negative fractions, and to assess enrichment and persistence of TCRs over multiple rounds of antigen stimulation. TCR pairs identified in this assay were selected based on their presence in the peptide-binding fractions following rounds 2 and 3, higher abundance in positive versus negative fractions in each of these rounds, and enrichment over time following multiple rounds of exposure to antigen.

The nucleotide sequences encoding the beta chain and alpha chain, respectively, of the cloned TCRs, were separated by a sequence encoding a P2A polypeptide and inserted into a vector, e.g. lentiviral vector, which were used for expressing the TCR chain in T cell lines and primary T cells using standard methods. The TCRs were cloned to contain a mouse constant region containing an added cysteine in the alpha and beta chains to create an engineered disulfide bond. The non-native disulfide bond was promoted by modifying the TCR chains at residue 48 in the Cα region from Thr to Cys and residue 57 of the Cβ region from Ser to Cys (see Kuball et al. (2007) Blood, 109:2331-2338). The lentiviral constructs also contained sequences encoding a truncated receptor as a surrogate marker for transduction and expression, separated from the recombinant TCR encoding sequences by a sequence encoding a T2A ribosome skip sequence.

C. Functional Assessment of Cells Transduced with T Cell Receptors

Primary CD4+ and CD8+ T cells were transduced with a lentiviral vector particle encoding selected TCRs. Such transduced T cells were assessed for functional activity, such as ability to specifically bind antigen and exhibit lytic activity in response to cells expressing the peptide: MHC.

CD8+ and CD4+ T cells were isolated from normal human donors and were stimulated with anti-CD3/anti-CD28 reagent, and then were transduced with a lentiviral preparation encoding various TCRs, or were subjected to a mock transduction control (cells treated under the same conditions used for lentiviral transduction but without addition of lentivirus). Following transduction, the cells were cultured in media containing human serum and cytokines.

After transduction, the cells were assessed by flow cytometry for staining with an antibody that recognized the surrogate marker, an anti-CD8 antibody, and a HPV 16 E6(29-38)- or HPV16 E7(11-19)-peptide-MHC tetramer complex. Cells expressing a reference TCR known to bind to an exemplary E6(29-38) or exemplary E7(11-19)-specific TCR also were assessed in this study (described in International PCT Publication No. WO 2015/184228). The reference TCR contains a mouse constant region.

Figure 2:
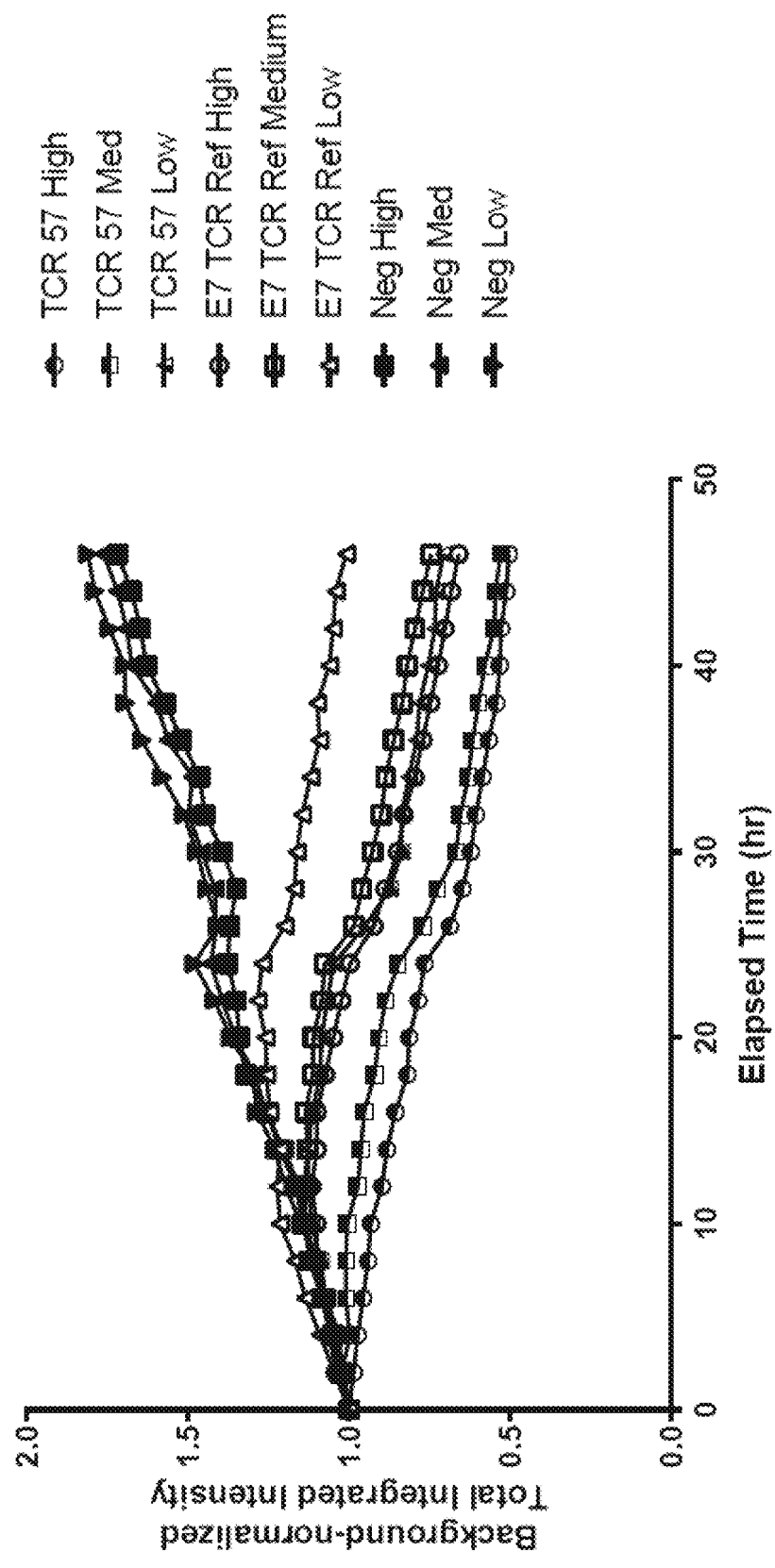
FIG. 2 shows lytic activity of TCR transduced primary T cells expressing TCR 57 incubated with SCC152 target cells at various effector:target (E:T) ratios based on the loss of viable target cells at various assessed time points compared to controls.

TCR-transduced primary T cells, including reference controls, also were assessed for their ability to lyse target cells in an antigen-specific manner using an antigen-expressing cancer cell line. TCR-transduced T cells were incubated with the squamous cell carcinoma cell line UPCI:SCC152 (ATCC® CRL-3240™) at various effector:target (E:T) ratios including 10:1, 5:1, and 2.5:1. Cultures with target cells that did not express a TCR with cytolytic activity ("Neg") were used as negative controls. T cells expressing TCR49, an E7(11-19)-specific TCR, were also tested. The target SCC152 cells were labeled with NucLight Red (NLR) to permit their tracking by microscopy. Cytolytic activity was assessed by measuring the loss of viable target cells over a period of two days for about 48 to 72 hours, as determined by red fluorescent signal (using the IncuCyte® Live Cell Analysis System, Essen Bioscience). Cytolytic activity against SCC152 target cells of exemplary TCR-transduced T cells at E:T ratio of 10:1 are shown in FIG. 1. Cytolytic activity of TCR 57-expressing T cells at each of the assessed E:T ratios, 10:1 (high), 5:1 (med), and 2.5:1 (low) compared to a reference TCR known to bind the same peptide epitope is shown in FIG. 2. As shown, TCR 57-expressing T cells exhibited substantial cytolytic activity even at the lowest E:T ratio assessed.

The results of the binding and cytolytic activity studies for exemplary identified TCRs are summarized in Table E1. Column 3 and 4 sets forth the percentage of CD8+ cells and CD8− cells (CD4+ cells) positive for E7(11-19)-specific tetramer staining in flow cytometry. Column 5 and 6 sets forth the percentage of CD8+ cells and CD8− cells (CD4+ cells) positive for E6(29-38)-specific tetramer staining in flow cytometry. As shown, TCR 57 exhibited CD8-independent binding. Column 7 of the table summarizes the binding activity to the relevant peptide from columns 3-6, indicating the ability of the TCRs expressed by primary T cells to specifically bind to peptide in the context of HLA:A02:01. As shown in Column 8, four TCR-expressing T cells (TCR 56, TCR 57, TCR63 and TCR64), and the reference control TCR-expressing T cells, were observed to exhibit lytic activity against target cells presenting the relevant HPV 16-derived peptide in the context of HLA-A02:01. Of interest, lytic activity in this assay was observed for TCR-expressing cells that did not exhibit detectable binding to the tetramer as measured by flow cytometry.

TABLE E1

Amino Acid and Nucleotide Sequences of HPV 16 E6(29-38)-Specific TCRs

| TCR | Epitope | E7(11-19) CD8+ | E7(11-19) CD8− | E6(29-38) CD8+ | E6(29-38) CD8− | Tetramer Binding | Cytolytic Activity |
|---|---|---|---|---|---|---|---|
| TCR 56 | — | 0.05 | 0.13 | 0.07 | 0.12 | No | Yes |
| TCR 57 | E7(11-19) | 94.97 | 86.03 | 0.23 | 0.19 | Yes | Yes |
| TCR 58 | E7(11-19) | 9.91 | 0.10 | 0.14 | 0.11 | Yes | No |
| TCR 59 | E7(11-19) | 28.00 | 0.16 | 0.11 | 0.16 | Yes | No |
| TCR 60 | E7(11-19) | 21.47 | 0.13 | 0.15 | 0.07 | Yes | No |
| TCR 61 | E7(11-19) | 17.20 | 0.13 | 0.15 | 0.12 | Yes | No |
| TCR 62 | E7(11-19) | 38.83 | 0.07 | 0.20 | 0.04 | Yes | No |
| TCR 63 | E7(11-19) | 0.30 | 0.25 | 0.23 | 0.12 | No | Yes |
| TCR 64 | E7(11-19) | 0.13 | 0.06 | 0.17 | 0.11 | No | Yes |
| TCR 65 | E6(29-38) | 0.26 | 0.07 | 5.20 | 0.23 | Yes | No |
| Reference | E7(11-19) | 92.37 | 82.69 | 0.18 | 0.10 | Yes | Yes |
| Reference | E6(29-38) | 0.10 | 0.27 | 9.23 | 0.24 | Yes | — |

D. Exemplary Identified TCRs

The identified TCRs also were re-formatted in a fully human format containing a human constant chain. Similar to the mouse constant region sequences, mutation(s) to promote the formation of a non-native disulfide bond in the interface between the TCR constant domains to increase pairing and stability of the TCR were included by modifying the TCR chains at residue 48 in the Cα region from Thr to Cys and residue 57 of the Cβ region from Ser to Cys (see Kuball et al. (2007) Blood, 109:2331-2338).

Table E2 lists exemplary E6(29-38)- and E7(11-19)-specific TCRs isolated, assessed, and sequenced using methods described above. The sequence identifiers (SEQ ID NO:) for the alpha and beta chain nucleotide and amino acid sequences, and with either human or mouse constant region sequences, is indicated. The table also lists the sequence identifier (SEQ ID NO:) corresponding to an exemplary full-length encoded amino acid sequence containing the beta and alpha chain sequences of each respective TCR, separated by a sequence encoding a ribosome-skip P2A sequence (P2A linker set forth in SEQ ID NO: 32 encoded by the nucleotides set forth in SEQ ID NO: 31) (designated "beta-P2A-alpha"). In some cases, TCR 57 and/or the other TCRs were alternatively formatted with a human beta constant region set forth in SEQ ID NO:350.

TABLE E2

Amino Acid and Nucleotide Sequences of HPV TCRs

SEQ ID NO.

| TCR | Full length beta-P2A-alpha aa Human constant | Full length beta-P2A-alpha aa Mouse constant | Alpha nt Human constant | Alpha nt Mouse constant | Alpha aa Human constant | Alpha aa Mouse constant | Beta nt Human constant | Beta nt Mouse constant | Beta aa Human constant | Beta aa Mouse constant |
|---|---|---|---|---|---|---|---|---|---|---|
| TCR 56 | 37 | 38 | 1 | 2 | 5 | 6 | 16 or 411 | 17 | 20 | 21 |
| TCR 57 | 69 | 70 | 39 | 40 | 43 | 44 | 52 or 361 | 53 | 56 | 57 |
| TCR 58 | 95 | 96 | 71 | 72 | 73 | 74 | 82 or 414 | 83 | 84 | 85 |
| TCR 59 | 118 | 119 | 97 | 98 | 99 | 100 | 108 or 415 | 109 | 110 | 111 |
| TCR 60 | 141 | 142 | 120 | 121 | 122 | 123 | 131 or 416 | 132 | 133 | 134 |
| TCR 61 | 161 | 162 | 143 | 144 | 145 | 146 | 151 or 417 | 152 | 153 | 154 |
| TCR 62 | 187 | 188 | 163 | 164 | 165 | 166 | 174 or 418 | 175 | 176 | 177 |
| TCR 63 | 213 | 214 | 189 | 190 | 191 | 192 | 200 or 419 | 201 | 202 | 203 |
| TCR 64 | 239 | 240 | 215 | 216 | 217 | 218 | 226 or 423 | 227 | 228 | 229 |
| TCR 65 | 265 | 266 | 241 | 242 | 243 | 244 | 252 or 424 | 253 | 254 | 255 |

In some cases, the nucleotide sequences encoding TCRs generated as described above were modified by codon optimization. The corresponding SEQ ID NO for the resulting modified nucleotide sequences and corresponding encoded amino acid sequences for the modified version of each TCR are shown in Table E3. For individual TCRs modified as described above, constructs were generated that contained the modified nucleotide sequences encoding the variable region of the beta chain and alpha chain, of the cloned TCRs, separated by a sequence encoding a P2A polypeptide is also provided in the table.

TABLE E3

Codon Optimized Nucleotide Sequences for TCRs

SEQ ID NO. of Modified Version of TCR

| TCR | Epitope | Full-length nt Human constant | Full-length nt Mouse constant | alpha Human constant | alpha Mouse constant | beta Human constant | beta Mouse constant |
|---|---|---|---|---|---|---|---|
| TCR 56 | — | 35 or 399 | 36 or 422 | 3 or 420 | 4 or 421 | 18 | 19 |
| TCR 57 | E7(11-19) | 67 | 68 | 41 | 42 | 54 | 55 |
| TCR 56 | — | 388 | — | 3 or 420 | — | 412 | — |
| TCR 57 | E7(11-19) | 390 | — | 41 | — | 413 | — |

Example 2: Assessment of Expression and Activity of an Exemplary Recombinant T Cell Receptor (TCR)

A polynucleotide encoding the exemplary TCR 57 (formatted on a human constant region with cysteine modifications as described in Example 1D with a human beta constant region set forth in SEQ ID NO:350, and in which the sequences encoding the TCRα and TCRβ chains were separated by a 2A ribosome skip element), were incorporated into an exemplary HIV-1 derived lentiviral vector. Pseudotyped lentiviral vector particles were produced by standard procedures by transiently transfecting HEK-293T cells with the resulting vectors, helper plasmids (containing gagpol plasmids and rev plasmid), and a pseudotyping plasmid and used to transduce cells.

Primary human CD4+ and CD8+ T cells were isolated from 5 independent donors by immunoaffinity-based methods. The isolated CD8+ and CD4+ T cells were separately stimulated with anti-CD3/anti-CD28 reagent, and then were separately transduced with a lentiviral vector encoding the TCR. As a control, the cells were transduced with a lentiviral vector encoding the reference E7(11-19)-specific TCR (containing a mouse constant region; International PCT Publication No. WO 2015/184228). Following transduction, the cells were cultured in media containing human serum and cytokines. The cells were assessed for cytolytic activity and ability to induce production of cytokines.

A. Reference TCR

For this study, comparison of activity was made to the reference E7(11-19)-specific TCR, which binds and exhibits activity in response to E7(11-19) and includes a mouse constant region (International PCT Publication No. WO 2015/184228). To assess whether the antigen-binding region of the reference TCR would exhibit E7 (11-19) antigen-specific activity when included in a TCR containing human constant regions, the alpha and beta chains of the reference TCR were replaced with fully human alpha and beta chain constant regions, respectively. The human constant regions used included mutation(s) at residue 48 in the Cα region from Thr to Cys and residue 57 of the Cβ region from Ser to Cys (see Kuball et al. (2007) Blood, 109:2331-2338) as described above. Primary human CD8+ T cells were transduced with a lentiviral vector particle encoding TCRs containing the reference TCR variable regions and either the mouse constant or human constant regions, or were subjected to a mock transduction control (cells treated under the same conditions used for lentiviral transduction but without addition of lentivirus).

Figure 3:
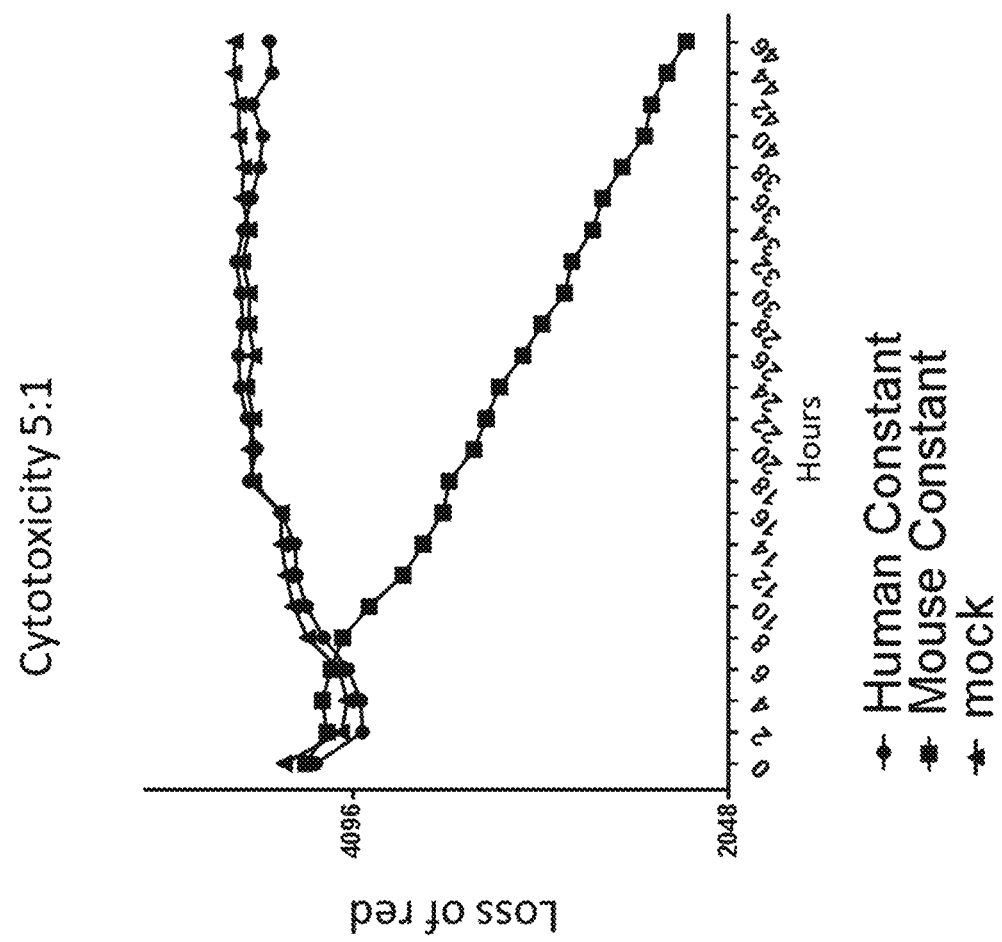
FIG. 3 shows assessment of reference TCR-transduced primary human T cells to lyse target cells in an antigen-specific manner using an antigen-expressing cancer cell line.

The reference TCR variable region-containing TCR-transduced primary human T cells were assessed for their ability to lyse target cells in an antigen-specific manner using an antigen-expressing cancer cell line. TCR-transduced T cells were incubated with the squamous cell carcinoma cell line UPCI:SCC152 (ATCC® CRL-3240™) at an effector:target (E:T) ratios of 5:1. The target SCC152 cells were labeled with NucLight Red (NLR) to permit their tracking by microscopy. Cytolytic activity was assessed by measuring the loss of viable target cells over a period of two days for about 46 hours, as determined by red fluorescent signal (using the IncuCyte® Live Cell Analysis System, Essen Bioscience). As shown in FIG. 3, T cells expressing TCRs including the reference TCR variable regions exhibited cytolytic activity when such TCRs included the mouse constant regions, but exhibited no cytolytic activity when such TCRs included the human constant regions. The results are consistent with negative impact of endogenous human TCR chain(s) on the expression, activity and/or function of recombinant TCRs including the variable regions of the reference TCR, when expressed in human T cells, and that such impacts may be mitigated by the inclusion of mouse constant regions in combination with the reference TCR variable regions (International PCT Publication No. WO 2015/184228).

B. Cytolytic Activity and Cytokine Production

Primary human CD8+ T cells and primary human CD4+ T cells, individually, engineered to express TCR 57 (containing human constant regions) or the reference TCR described in Example 2A above (containing mouse constant regions), were assessed for antigen-specific activity. Cells expressing the respective recombinant TCRs (effector cells) were cultured with target cells expressing HPV 16 E7 labeled with NucLight Red (NLR). The ability of the T cells to antigen-specifically lyse the target cells was assessed by measuring the loss of labeled target cells every 2 hours for 48 hours post co-culture. The area under the curve (AUC) for % killing was calculated. Cytokine production was assessed by measuring interferon-gamma (IFNγ) by ELISA in the supernatant collected at 48 hours after the co-culture with target cells described above. For comparison to the reference TCR-expressing T cells, the AUC of killing and cytokine production of the reference TCR-expressing T cells (CD8+ or CD4+) were normalized to killing observed by TCR 57-expressing T cells (CD8+ or CD4+), and the fold change determined.

Figure 4A:
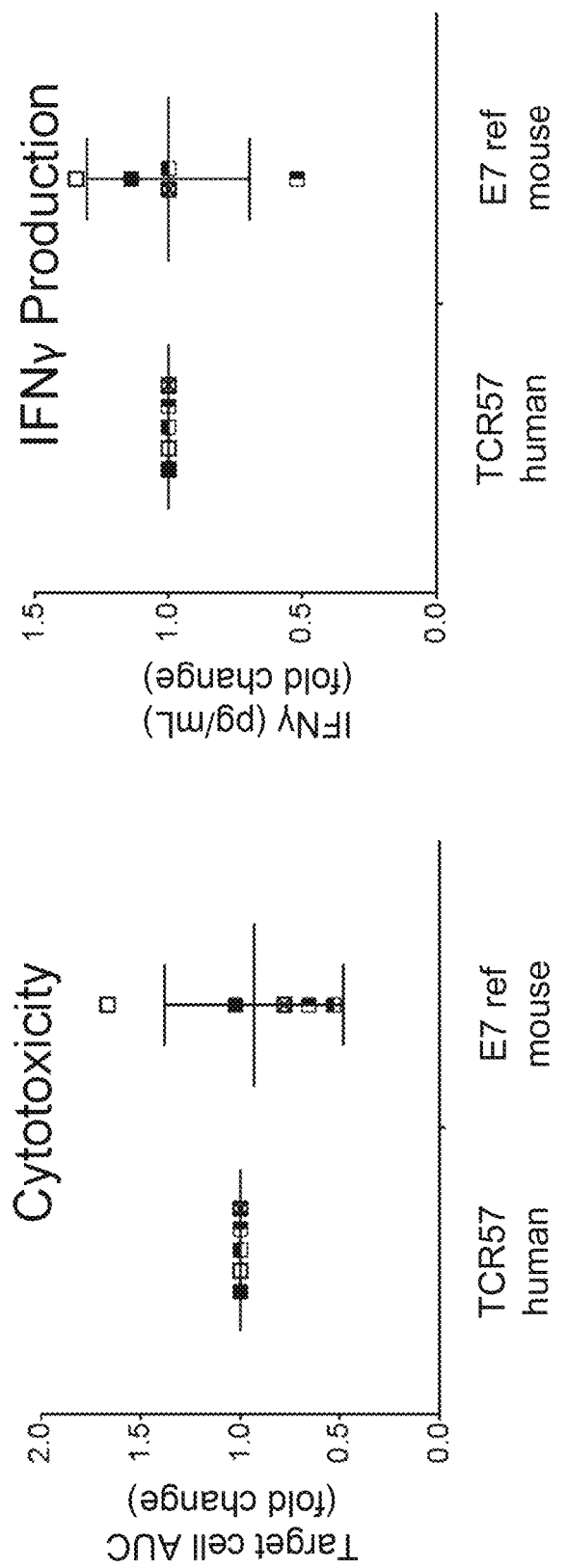
FIG. 4A shows cytolytic activity and cytokine production of TCR-expressing CD8+ T cells as measured be culturing recombinant TCR-expressing effector cells with target cells expressing HPV 16 E7 labeled with NucLight Red (NLR).
Figure 4B:
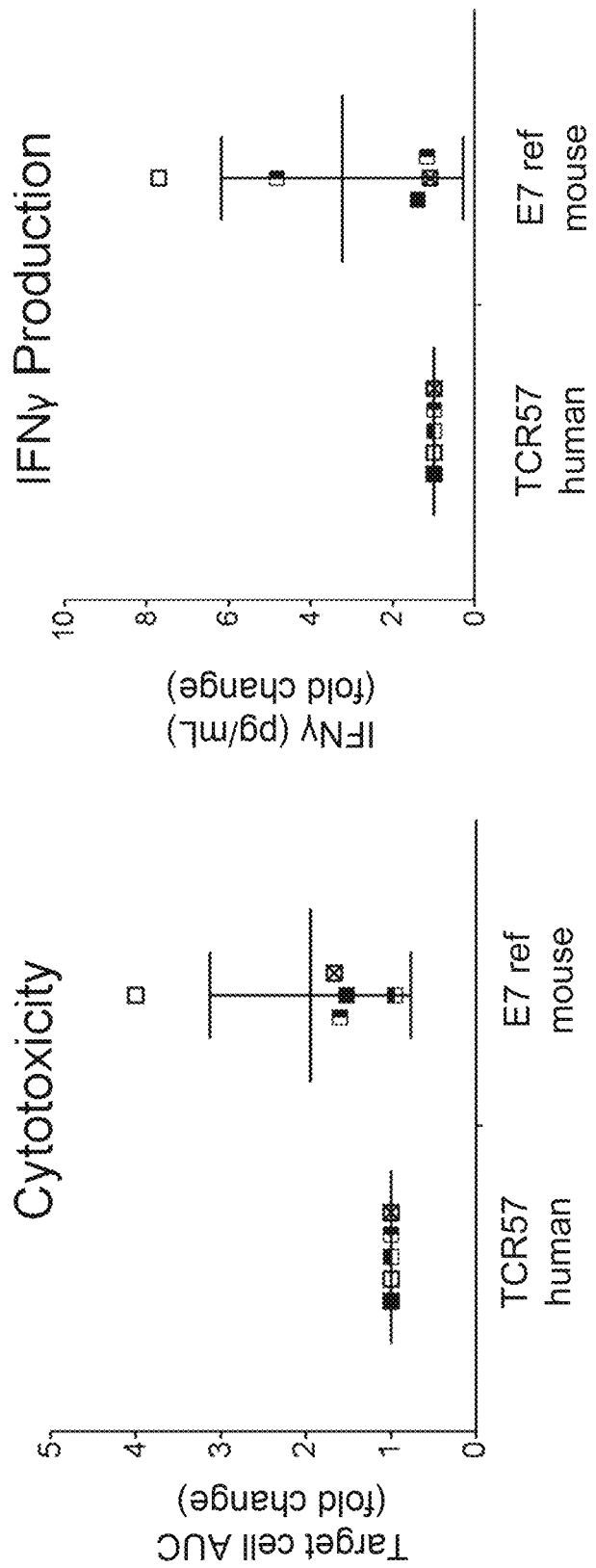
FIG. 4B shows cytolytic activity and cytokine production of TCR-expressing CD4+ T cells as measured by culturing recombinant TCR-expressing effector cells with target cells expressing HPV 16 E7 labeled with NucLight Red (NLR).

The results for TCR-expressing CD8+ T cells are shown in FIG. 4A and the results for TCR-expressing CD4+ T cells are shown in FIG. 4B. As shown, the TCR 57-expressing CD8+T and TCR 57-expressing CD4+ T cells exhibited cytolytic activity against target cells and antigen-specific cytokine production. Results were at least comparable to activity observed for the reference TCR (containing mouse constant region)-expressing T cells. The activity observed in CD4+ T cells is consistent with the ability of cells expressing TCR 57 or a TCR with its antigen-binding regions to exhibit antigen-specific activity in a CD8-independent manner. Furthermore, the results demonstrate that, unlike for the variable regions of the reference TCR, human T cells expressing recombinant TCRs with the antigen binding regions of TCR 57 and including human constant regions were able to exhibit such activity in human T cells. These results are consistent with a finding that the ability of recombinant TCRs containing the variable regions of TCR 57 may not be negatively impacted by the presence of an endogenous human TCR chains, to the degree that is observed for TCRs containing other variable regions, such as the variable regions of the reference TCR. In some embodiments, the ability of TCRs provided herein to be less impacted by endogenous human TCR chains, when expressed in human cells, or of such cells to maintain activity in the presence of endogenous TCR chains, may be due to the ability of the provided TCR to better compete with endogenous TCR for signaling components, such as CD3 signaling components. Such ability in some embodiments may be conferred by one or more properties of the TCR, such as sequence-specific properties, for example, of the variable region(s) and/or antigen binding regions of the TCR.

Example 3: Assessment of In Vivo Anti-Tumor Effects in Mice of T Cells Engineered to Express a Recombinant T Cell Receptor (TCR)

Anti-tumor activity of primary human CD4+ and primary human CD8+ T cells expressing recombinant TCRs containing the variable regions of TCR 57 (and containing human constant regions with cysteine modifications as described in Example 1D with a human beta constant region set forth in SEQ ID NO:350, and in which the sequences encoding the TCRα and TCRβ chains were separated by a 2A ribosome skip element) was assessed in vivo by administration of the engineered cells in a mouse tumor model. Anti-tumor activity of these cells was compared to activity of human T cells engineered to express the E7(11-19) reference TCR (containing mouse constant regions, described in Example 2A above; International PCT Publication No. WO 2015/184228). The mouse tumor model was generated by subcutaneous injection of squamous cell carcinoma cell line UPCI:SCC152 (ATCC® CRL-3240™) cells in female NOD/SCID/IL-2Rγ$^{null}$ (NSG) mice. Approximately 3 weeks after injection, at which time the tumor-bearing mice exhibited a mean tumor volume of about 150 mm$^3$, the mice were staged into groups (n=7 mice/group). The mice of each group were intravenously administered either 3×10$^6$ or 1.5×10$^6$ TCR-expressing cells. In this study, the mean tumor volume was assessed twice a week for up to 80 days after administration of the engineered cells.

Figure 5A:
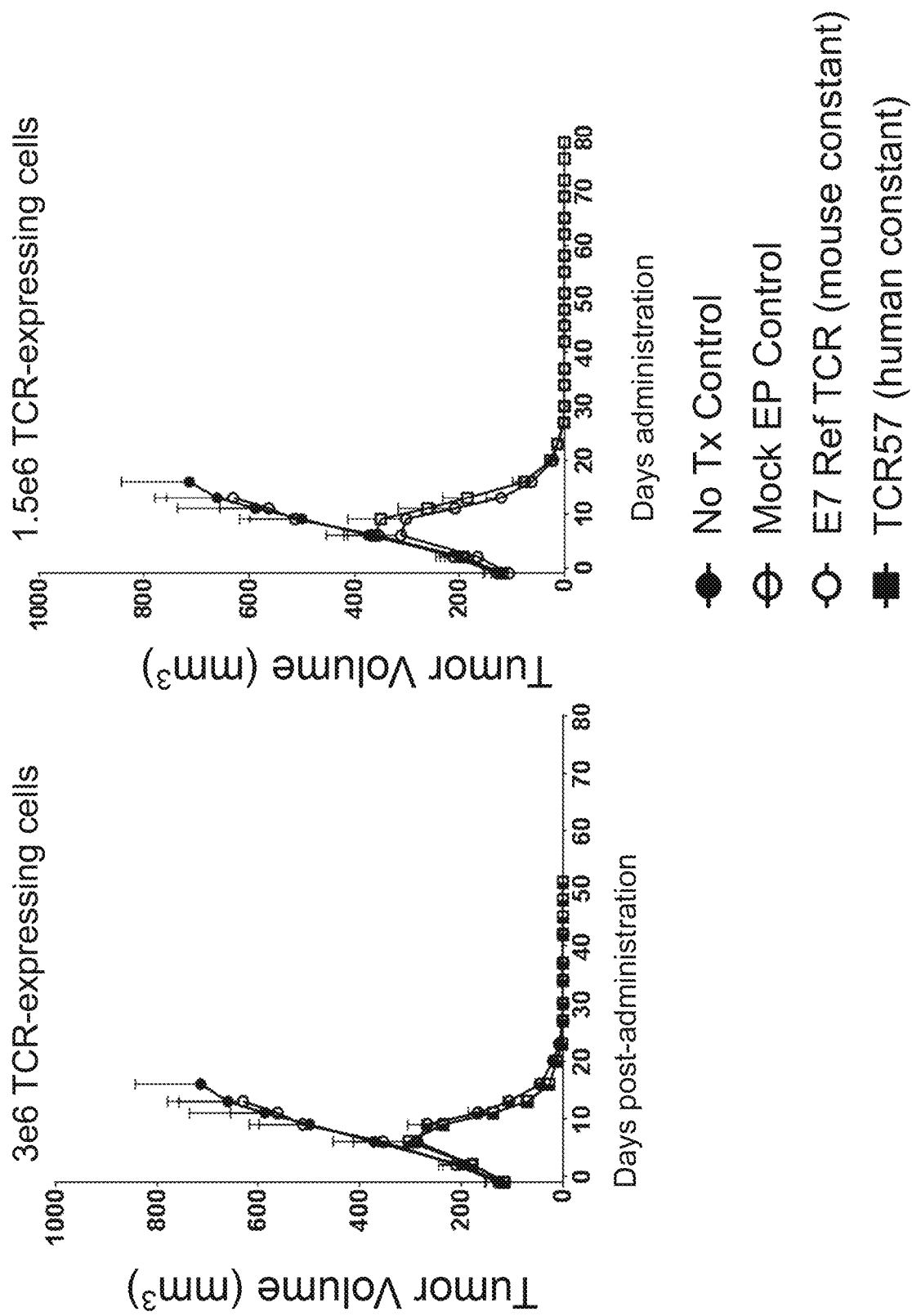
FIGS. 5A-5B show in vivo anti-tumor activity of CD4+ and CD8+ human T cells expressing recombinant TCR 57 assessed by administration of the engineered cells in a mouse tumor model.
Figure 5B:
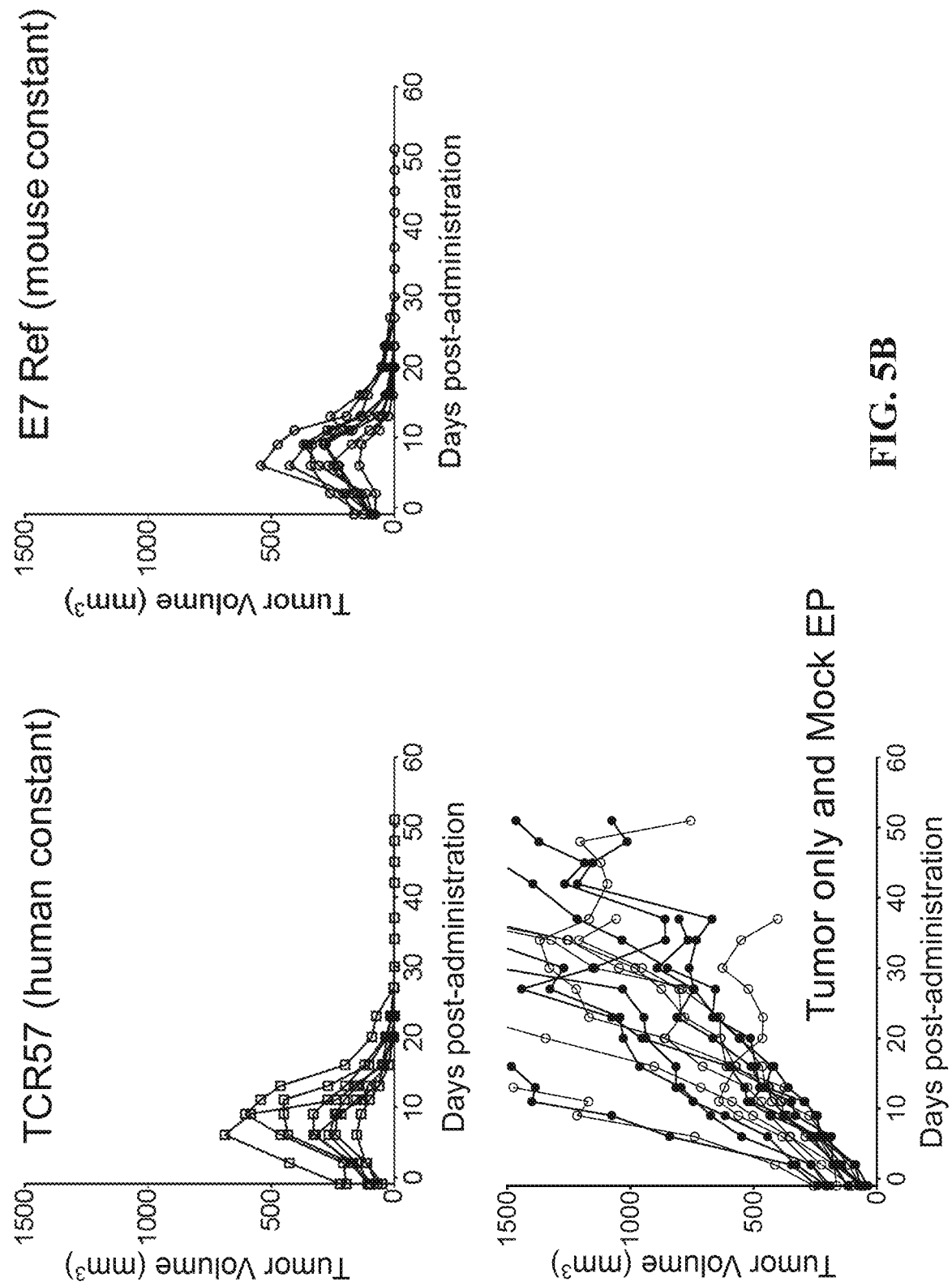

Results are shown in FIG. 5A (mean tumor volume) and in FIG. 5B (tumor volume of individual mice per group). Primary human T cells expressing recombinant TCR 57 exhibited anti-tumor activity in this model that was at least comparable to cells expressing the recombinant reference TCR containing the mouse constant region, as evidenced by a substantially complete reduction in tumor volume through at least day 80, the last time-point assessed in the study at both cell doses tested. The results are consistent with an observation that T cells engineered to express a TCR having the antigen-binding region of TCR 57 and containing human constant regions are capable of exhibiting substantial anti-tumor activity in the presence of the endogenous human TCR.

Example 4: Assessment of Expression of an Exemplary Recombinant T Cell Receptor (TCR) Compared to a Reference TCR Cell surface expression of an exemplary anti-human papillomavirus 16 (HPV16) E7(11-19) T cell receptor (TCR) was assessed, and compared to those of a reference anti-HPV16 TCR.

Primary human CD4+ and CD8+ T cells were isolated from independent donors by immunoaffinity-based methods, stimulated with anti-CD3/anti-CD28 reagent, and then were transduced with a lentiviral vector encoding an exemplary TCR (containing variable regions from TCR 57 and human constant regions with cysteine modifications as described in Example 1D with a human beta constant region set forth in SEQ ID NO:350, and in which the sequences encoding the TCRα and TCRβ chains were separated by a 2A ribosome skip element), generally as described in Example 2 above. As a control, the cells were transduced with a lentiviral vector encoding the reference E7(11-19)-specific TCR (containing a mouse constant region described in Example 2A above). After transduction and culture, the cells were assessed by flow cytometry for cell surface expression of the recombinant TCR and CD8 dependence by staining with anti-Vbeta2 antibody (for TCR 57) or anti-Vbeta22 antibody (for reference TCR), a HPV16 E7(11-19)-peptide-MHC tetramer complex, and an anti-CD8 antibody.

Figure 6B:
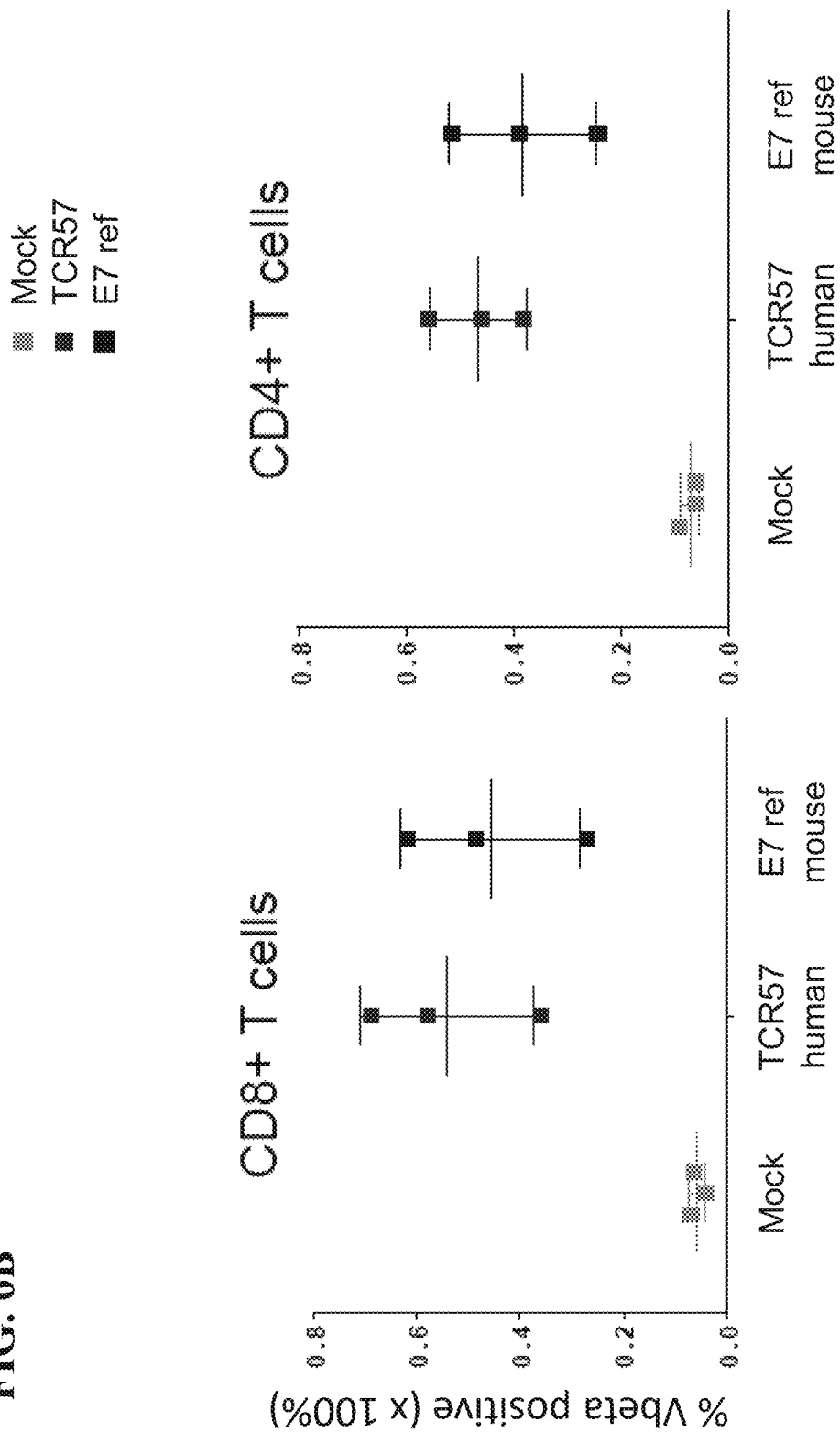

As shown in FIGS. 6A-6B, the exemplary TCR (containing variable regions from TCR 57 and human constant regions) was expressed on the surface of the cells and bound the E7(11-19) peptide-MHC tetramer complex, at comparable levels to the reference TCR containing mouse constant regions. On average, approximately 50-60% of the transduced cells exhibited cell surface expression of the TCR, using cells from 3 or more independent donors. The results showed high levels of expression and specific tetramer binding of CD4+ and CD8+ cells expressing the exemplary TCR, even in the presence of the endogenous human TCR chains.

Example 5: Assessment of Activity of an Exemplary Recombinant T Cell Receptor (TCR) Compared to a Reference TCR Cytolytic activity and cytokine secretion of an exemplary anti-human papillomavirus 16 (HPV16) E7(11-19) T cell receptor (TCR) was assessed, and compared to those of a reference anti-HPV16 TCR.

Primary human CD4+ and CD8+ T cells from 3 independent donors, engineered to express TCR 57 or the reference TCR as a control (described in Examples 3 and 4 above), were assessed for antigen-specific cytolytic activity and cytokine production. Cells expressing the exemplary TCR (effector cells) were cultured with various target cells: K562 human chronic myelogenous leukemia (CML) cells (ATCC® CCL-243™) expressing HPV 16 E7, UPCI: SCC152 human squamous cell carcinoma (ATCC® CRL-3240™) cells, UPCI:SCC090 human squamous cell carcinoma (ATCC® CRL-3239™) cells or CaSki human epidermoid carcinoma (ATCC® CRL-1550™) cells expressing HPV 16 E7, labeled with NucLight Red (NLR), at an effector:target (E:T) ratio of 1:25:1, 2.5:1, 5:1 or 10:1. The ability of the T cells to antigen-specifically lyse the target cells was assessed by measuring the loss of labeled target cells, as determined by red fluorescent signal (using the IncuCyte® Live Cell Analysis System, Essen Bioscience). The area under the curve (AUC) for % killing was calculated, and the results were normalized to the AUC of mock controls. Cytokine production was assessed by measuring interferon-gamma (IFNγ), tumor necrosis factor alpha (TNFα) and interleukin-2 (IL-2), generally as described in Example 2B above. As controls, cytolytic activity and cytokine production after culturing with K562 cells expressing HPV16 E6 (non-specific antigen) or SiHa squamous cell carcinoma cells (ATCC® HTB-35™) expressing HPV16 E7 but not expressing HLA-A02:01, were also assessed.

Figure 7A:
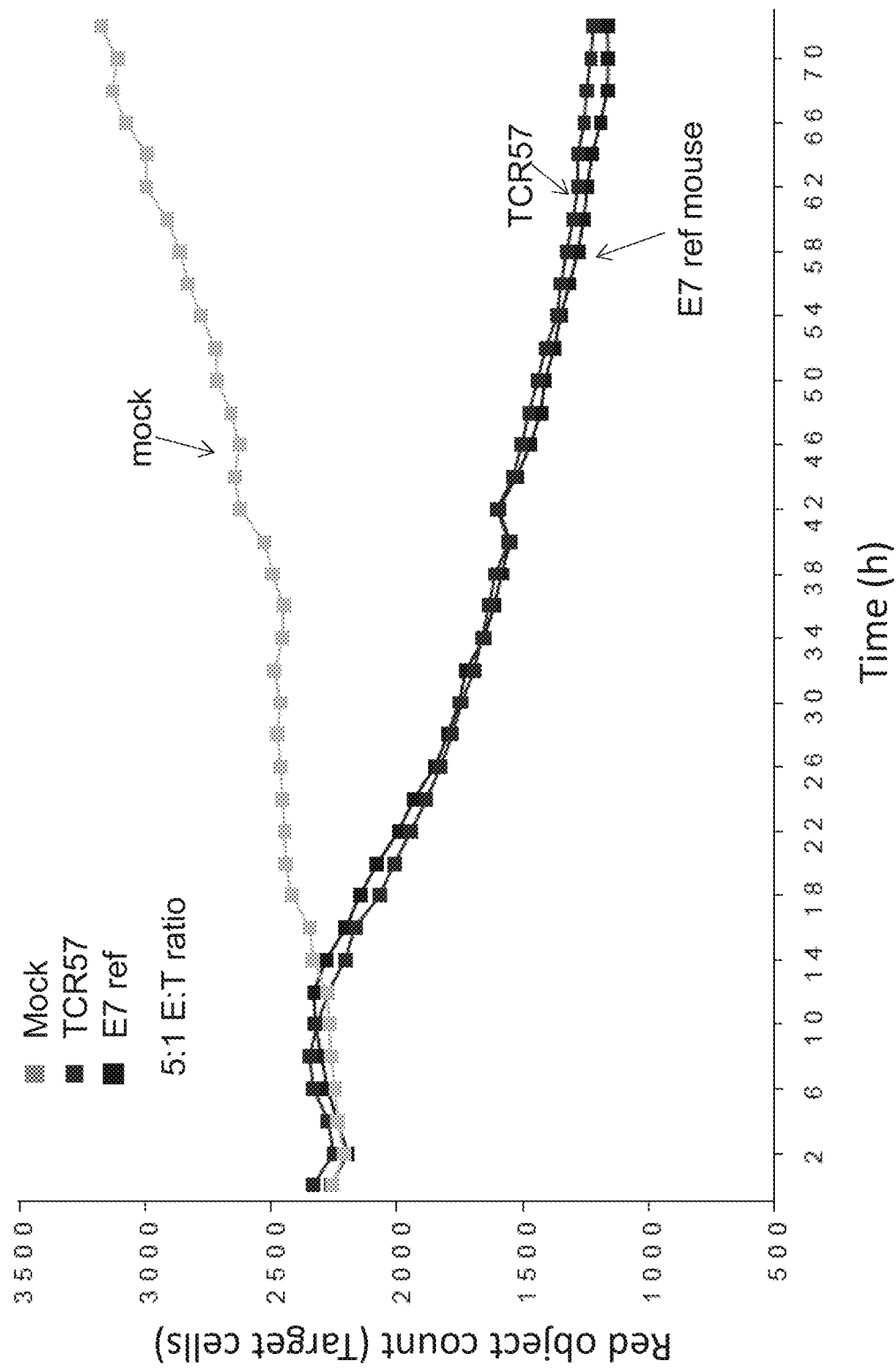
FIG. 7A depicts the cytolytic activity of CD8+ T cells expressing recombinant TCR57, a reference TCR (E7 Ref) and mock control, indicated by the loss of red fluorescent labeled target cells using the IncuCyte® Live Cell Analysis System (Essen Bioscience).
Figure 7C:
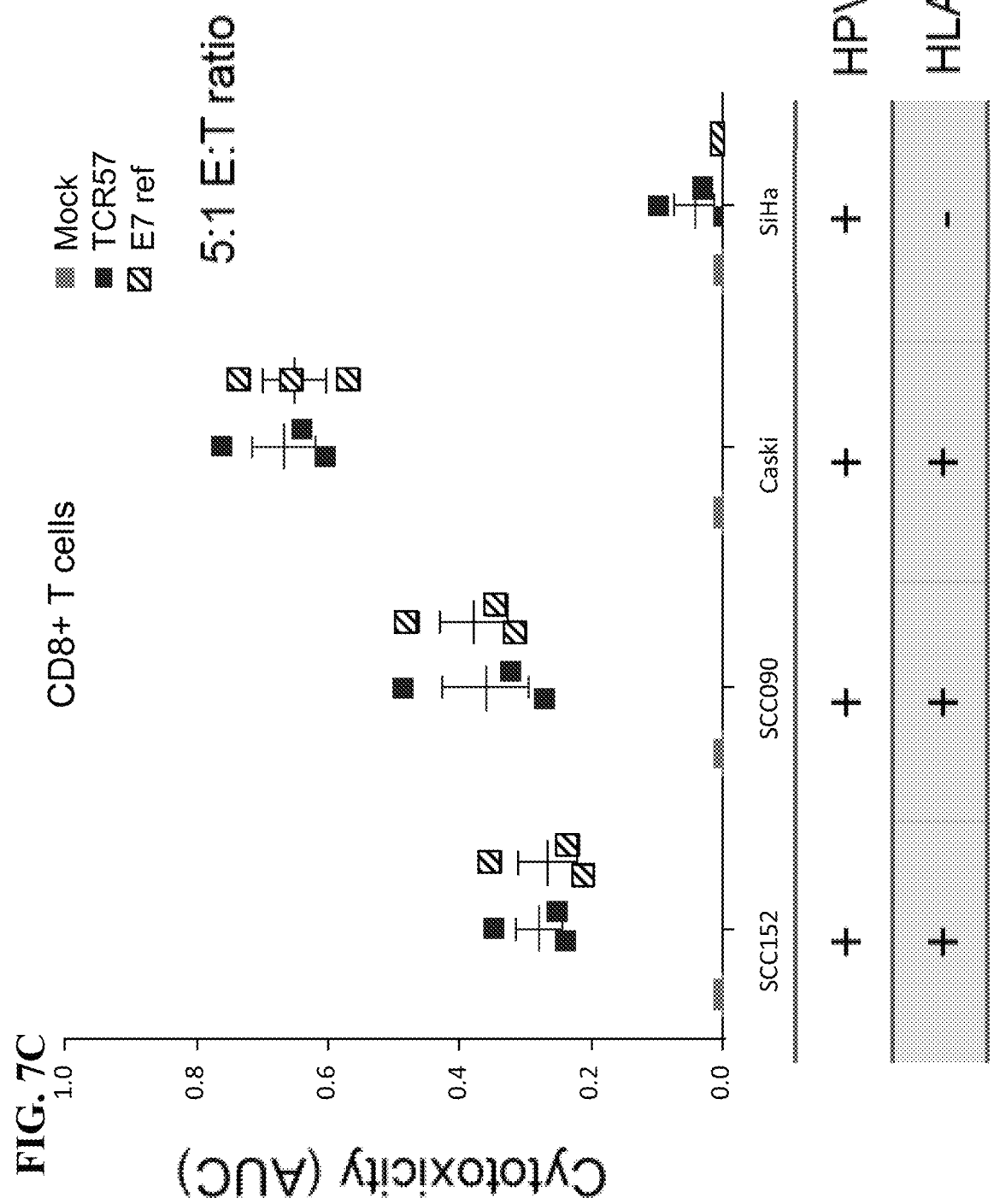
Figure 7D:
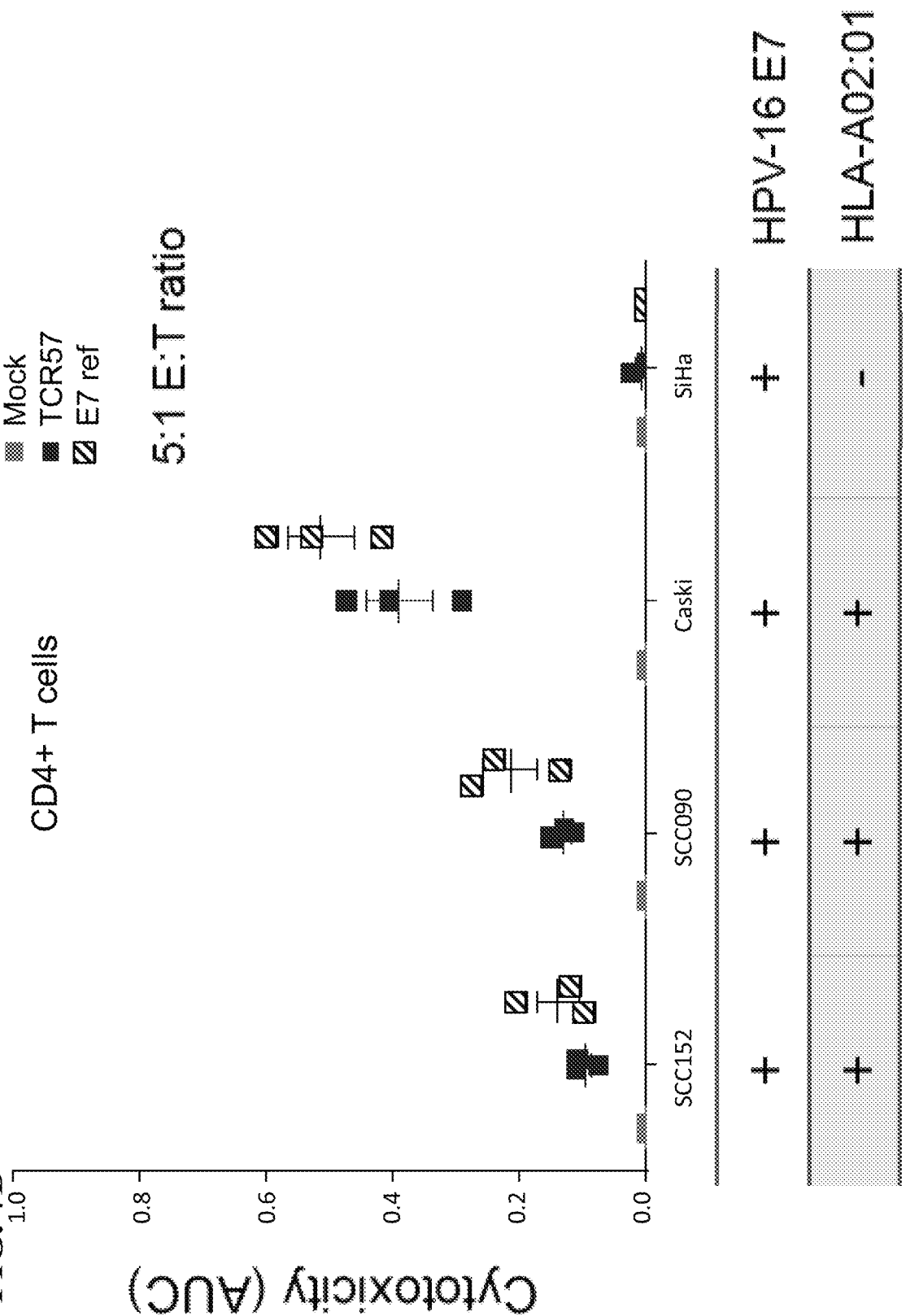
Figure 7E:
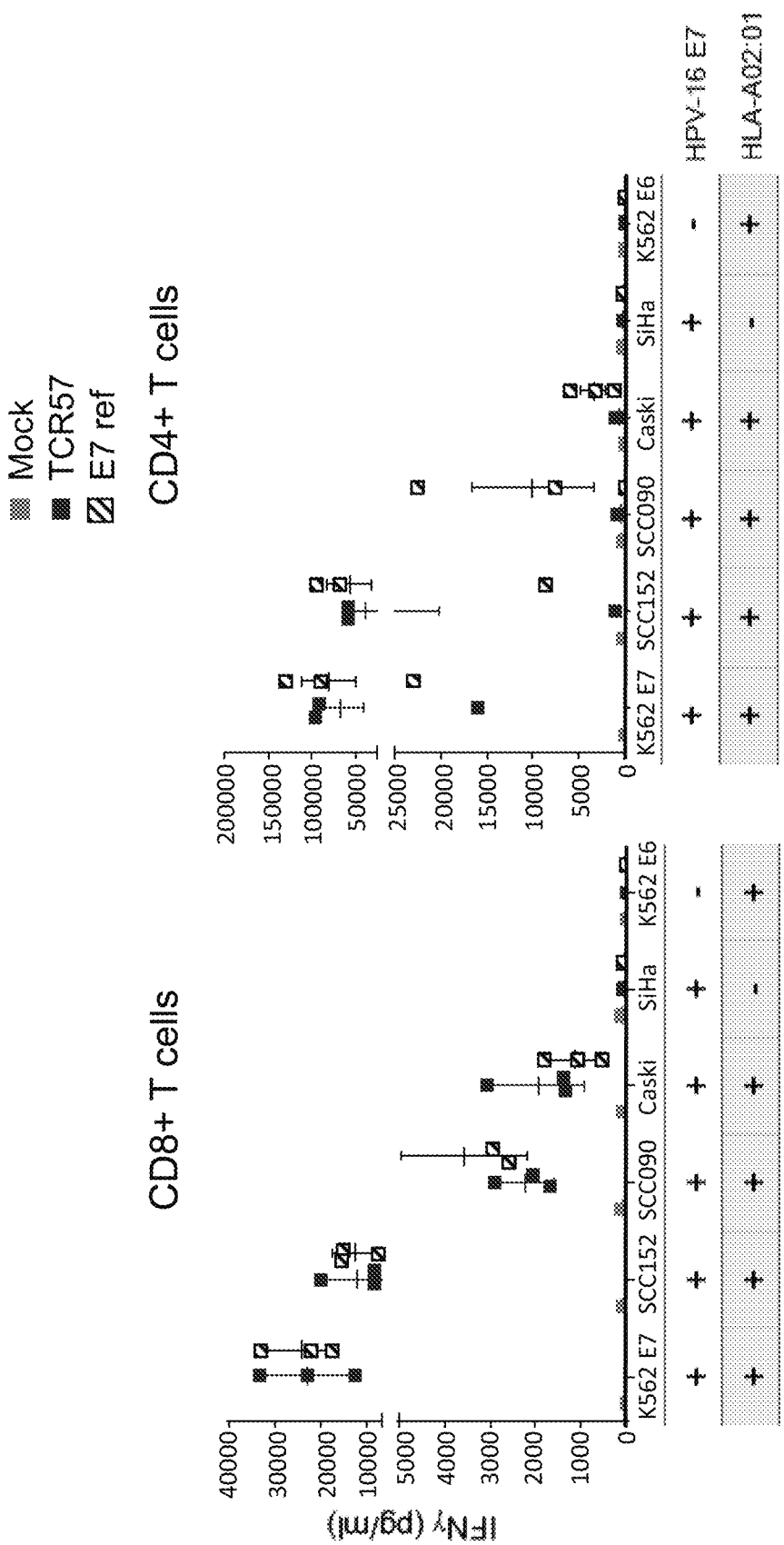
FIG. 7E shows interferon-gamma (IFN-γ) production for CD8+ and CD4+ T cells after co-culture with HPV E7-expressing target cells SCC152, SCC090, CaSKi and K562-E7 (K562 cells expressing E7). K562-E6 (expressing non-specific antigen) or SiHa squamous cell carcinoma cells expressing HPV16 E7 but not expressing HLA-A02:01, were assessed as control.

As shown in FIGS. 7A-7D, both CD8+(FIGS. 7A-7C) and CD4+(FIGS. 7B and 7D) T cells expressing TCR 57, an exemplary anti-HPV16 E7 TCR, exhibited antigen-specific cytotoxicity of various target cells at various E:T ratios tested, to an extent similar to cells expressing the reference TCR containing a mouse constant region. As shown in FIG. 7E, both CD8+ and CD4+ T cells produced IFNγ following co-culture with various types of target cells expressing HPV 16 E7, generally to an extent similar to cells expressing the reference TCR containing a mouse constant region. Similar results were observed for TNFα and IL-2 production.

The results were consistent with antigen- and HLA subtype-specific cytolytic activity and cytokine production by T cells engineered to express TCR 57 (containing human constant regions), including at low E:T ratios, indicating that the potent activity of the exemplary TCR. The results also showed that engineered CD4+ cells can also themselves contribute to cytolytic activity, in addition to producing cytokines to help CD8+ T cells.

Example 6: Assessment of In Vivo Anti-Tumor Effects in Mice of CD4+ or CD8+ T Cells Engineered to Express an Exemplary Recombinant T Cell Receptor (TCR)

Anti-tumor activity of the CD4+ and CD8+ primary T cells from human donors engineered to express an exemplary TCR (containing the variable regions of TCR 57 and human constant regions with cysteine modifications as described in Example 1D with a human beta constant region set forth in SEQ ID NO:350, and in which the sequences encoding the TCRα and TCRβ chains were separated by a 2A ribosome skip element) with cysteine modifications was assessed in vivo by administration of the engineered cells in an SCC152 tumor xenograft mouse model, generally as described in Example 3 above with the following exceptions: $3 \times 10^6$ engineered CD8+ cells only or $3 \times 10^6$ engineered CD4+ cells only were administered per mouse. Mean tumor volume was assessed for up to 80 days after administration of the engineered cells, and compared to the mean tumor volume in mice that received tumor xenograft only (tumor only), or T cells that were mock transduced (mock).

Figure 8:
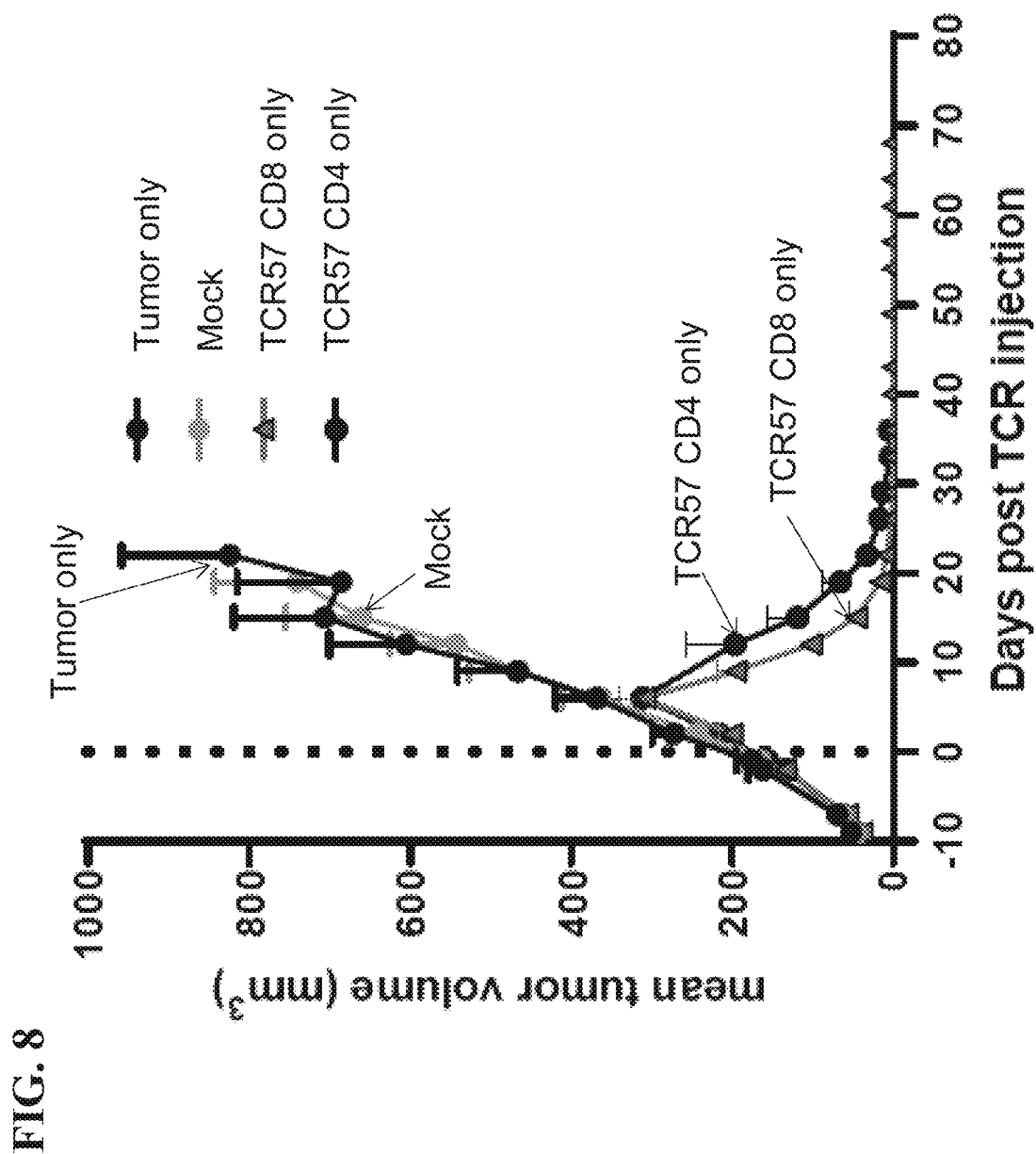
FIG. 8 shows in vivo anti-tumor activity of CD4+ and CD8+ human T cells expressing recombinant TCR 57, as after administration of engineered cells in a mouse tumor model and represented as changes in mean tumor volume over time.

As shown in FIG. 8, mice administered either primary human CD4+ cells only or engineered primary human CD8+ cells only, engineered to express the exemplary TCR (containing variable regions from TCR 57 and human constant regions), exhibited a substantially complete reduction in tumor volume. The results were consistent with an observation that both CD4+ cells and CD8+ cells contribute to anti-tumor activity in the mouse.

Example 7: Evaluation of Target Specificity of an Exemplary Recombinant T Cell Receptor (TCR)

Target binding specificity and human leukocyte antigen (HLA) subtype specificity of an exemplary anti-HPV16 E7(11-19) TCR were assessed.

A. Peptide Scanning

A synthetic peptide scanning library was generated to assess the binding motif of the epitope bound by the exemplary anti-HPV16 E7(11-19) TCR (containing variable regions from TCR 57 and human constant regions with cysteine modifications as described in Example 1D with a human beta constant region set forth in SEQ ID NO:350, and in which the sequences encoding the TCRα and TCRβ chains were separated by a 2A ribosome skip element). A 180-member peptide library was synthesized, with all 20 amino acids present in all 9 peptide positions of the HPV16 E7(11-19) (YMLDLQPET; SEQ ID NO:271). For antigen presentation, T2 (174×CEM.T2) lymphoblast (ATCC® CRL-1992™) cells expressing major histocompatibility complex (MHC) type HLA-A02:01 and lacking endogenous peptides were pulsed with the synthesized peptides in the library. The peptide-pulsed T2 cells were co-cultured with a Jurkat T reporter cell line expressing TCR 57 and containing a luminescent reporter induced by activation of signal from the T cell receptor, and luminescence was assessed.

The results of the reporter assay identified potentially permissive residues at each position of the E7(11-19) peptide, which are shown in Table E4 below.

TABLE E4

Permissive Residues at Each Position of the E7(11-19) Peptide

| Position | E7(11-19) WT residue | Permissive residues |
| --- | --- | --- |
| 1 | Y | ANCHILMFSTWV |
| 2 | M | CQL |
| 3 | L | ACIMV |
| 4 | D | NC |
| 5 | L | CMFY |
| 6 | Q | H |
| 7 | P | C |
| 8 | E | ARNDCQGHIKMPSTWV |
| 9 | T | ADCILMFSV |

The human genome was searched for permissive motifs that may be present in endogenous human proteins. 22 candidate peptides were identified, and were pulsed onto T2 cells and assessed using the Jurkat reporter described above. Two peptides (Peptide A and Peptide B) exhibited luminescence signal using this assay. The two peptides were assessed for binding to TCR 57, by peptide titration assay and in silico analysis for affinity to HLA-A02:01 using the Immune Epitope Database (IEDB).

Figure 9:
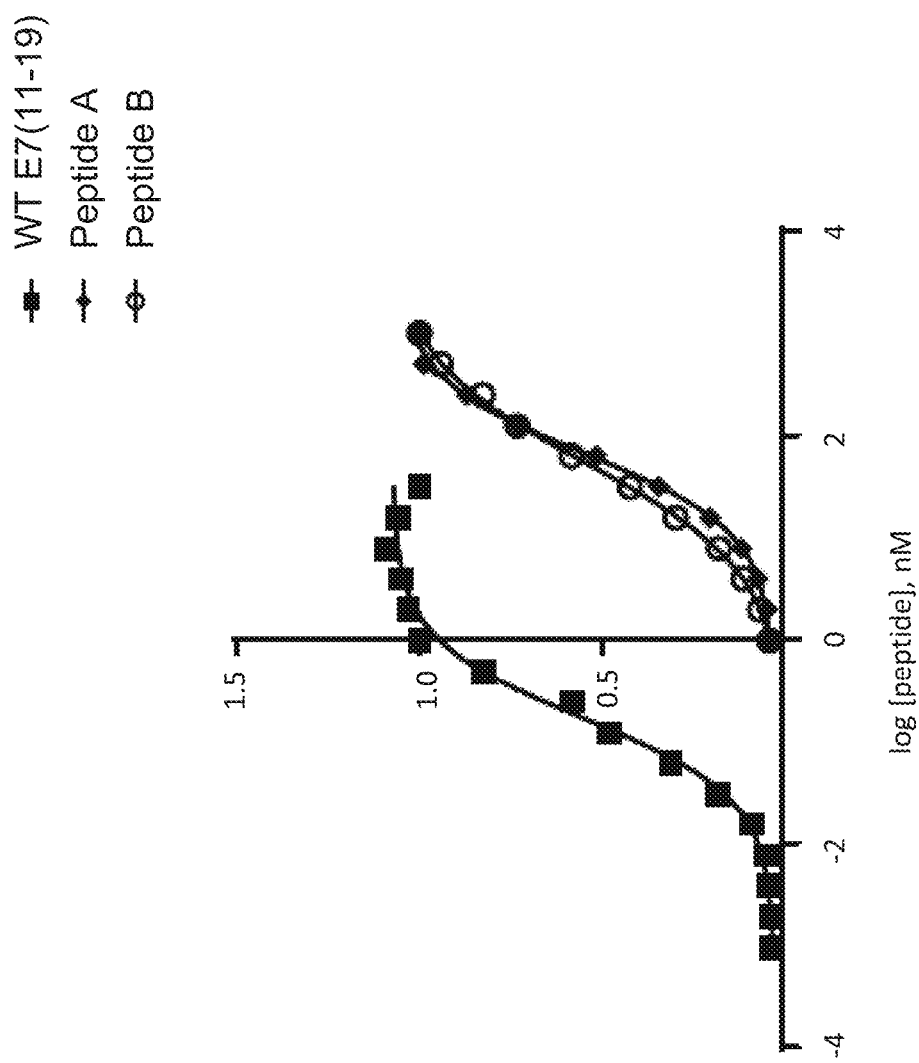
FIG. 9 shows the result of peptide titration to determine sensitivity of TCR 57 for non-target peptides Peptide A and Peptide B.

As shown in FIG. 9, TCR 57 exhibited greater sensitivity for the HPV16 E7(11-19) peptide compared to its sensitivity for Peptide A and Peptide B. Peptide A, but not Peptide B, exhibited a relatively high affinity for HLA-A02:01, as determined by the in silico analysis.

Engineered reporter T cells expressing TCR 57 were also assessed for activation signal (via luminescence reporter) and cytolytic activity against target cells that are known to endogenously express the proteins containing Peptide A or Peptide B (B cells and T cells). The results showed that TCR 57 did not exhibit activation or cytolytic activity against cells that endogenously express Peptide A or Peptide B (B cells and T cells).

B. HLA Subtype Specificity

The specificity of human leukocyte antigen (HLA) subtypes recognized by the exemplary TCR (containing variable regions from TCR 57 with cysteine modifications as described in Example 1D with a human beta constant region set forth in SEQ ID NO:350, and in which the sequences encoding the TCRα and TCRβ chains were separated by a 2A ribosome skip element) was assessed using a panel of B-lymphoblastoid cell lines (BLCL) expressing various common HLA alleles. A panel of more than 70 BLCLs expressing more than 95 different HLA-A, B or C alleles, covering 95% of the most common HLA alleles in the North American population, either displayed endogenous peptides or were pulsed with the E7(11-19) peptide, and were co-cultured with Jurkat T reporter cell line expressing TCR57 described above.

The results showed that TCR 57 only showed activity against E7(11-19) peptide pulsed cells expressing HLA-A02:01. No alloreactivity was observed across all other tested HLA subtypes.

The results were consistent with an observation that the exemplary TCR (containing variable regions from TCR 57) does not exhibit substantial off-target activity, nor reactivity to different HLA subtypes. The results showed that the exemplary TCR exhibited specific and sensitive activity against the HPV 16 E7(11-19) peptide, and a reduced or low risk of off-target activity.

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

SEQUENCE TABLE

| SEQ ID NO | SEQUENCE | Description |
| --- | --- | --- |
| 1 | ATGGCTCAGGAACTGGGAATGCAGTGCCAGGCTCGTGGTATCCTGCAGCAGATGTGGGGAGT TTTCCTTCTTTATGTTTCCATGAAGATGGGAGGCACTACAGGACAAAACATTGACCAGCCCA CTGAGATGACAGCTACGGAAGGTGCCATTGTCCAGATCAACTGCACGTACCAGACATCTGGG TTCAACGGGCTGTTCTGGTACCAGCAACATGCTGGCGAAGCACCCACATTTCTGTCTTACAA TGTTCTGGATGGTTTGGAGGAGAAAGGTCGTTTTTCTTCATTCCTTAGTCGGTCTAAAGGGT ACAGTTACCTCCTTTTGAAGGAGCTCCAGATGAAAGACTCTGCCTCTTACCTCTGTGCTGTG | TCR 56 Alpha Native with Codon Optimized Human Constant (nt) |

SEQUENCE TABLE

| SEQ ID NO | SEQUENCE | Description |
|---|---|---|
| | AGAGATTGGGGATATGGTGGTGCTACAAACAAGCTCATCTTTGGAACTGGCACTCTGCTTGC<br>TGTCCAGCCAAATATCCAGAATCCGGACCCcgcggtatatcaactgcgcgactcaaaatcat<br>ccgataagagtgtctgtttgtttactgacttcgacagtcaaactaatgtctctcagagcaaa<br>gattccgatgtctacatcactgacaagtgcgttctggatatgcggagcatggattttaagtc<br>caactccgccgtagcctggtccaacaagtcagactttgcctgtgcaaatgctttcaacaact<br>caattatccctgaggacacttttctttccttcaccggagtcctcatgcgatgttaaactggtc<br>gaaaaatcttttgagacggatacgaacctcaacttccaaaatttgagcgttattggctttag<br>gattctgcttctcaaggttgcggggttcaatctcctgatgacgttgcggctttggagcagct<br>aa | |
| 2 | ATGGCTCAGGAACTGGGAATGCAGTGCCAGGCTCGTGGTATCCTGCAGCAGATGTGGGGAGT<br>TTTCCTTCTTTATGTTTCCATGAAGATGGGAGGCACTACAGGACAAAACATTGACCAGCCCA<br>CTGAGATGACAGCTACGGAAGGTGCCATTGTCCAGATCAACTGCACGTACCAGACATCTGGG<br>TTCAACGGGCTGTTCTGGTACCAGCAACATGCTGGCGAAGCACCCACATTTCTGTCTTACAA<br>TGTTCTGGATGGTTTGGAGGAGAAAGGTCGTTTTCTTCATTCCTTAGTCGGTCTAAAGGGT<br>ACAGTTACCTCCTTTTGAAGGAGCTCCAGATGAAAGACTCTGCCTCTTACCTCTGTGCTGTG<br>AGAGATTGGGGATATGGTGGTGCTACAAACAAGCTCATCTTTGGAACTGGCACTCTGCTTGC<br>TGTCCAGCCAAATATCCAGAATCCGGAGCCTGCCGTGTACCAGCTGAAGGACCCACGGAGCC<br>AGGATAGCACCCTGTGCCTGTTCACCGACTTTGATTCTCAGATCAACGTGCCCAAGACCATG<br>GAGAGCGGCACCTTCATCACAGACAAGTGCGTGCTGGATATGAAGGCCATGGACAGCAAGTC<br>CAACGGCGCCATCGCCTGGTCCAATCAGACATCTTTCACCTGCCAGGATATCTTTAAGGAGA<br>CAAATGCCACCTATCCTTCCTCTGACGTGCCATGTGATGCCACCCTGACAGAAGAGCTTC<br>GAGACCGACATGAACCTGAATTTTCAGAATCTGCTCGTGATTGTCCTGAGAATCCTGCTGCT<br>GAAGGTGGCCGGCTTTAACCTGCTGATGACCCTGAGGCTGTGGAGCTCCTGA | TCR 56 Alpha Native with Codon Optimized Mouse Constant (nt) |
| 3 | atggctcaagagctgggcatgcagtgtcaggccagaggaatcctgcagcagatgtggggagt<br>gttcctgctgtacgtgtccatgaagatgggcggcaccaccggccagaacatcgatcagccta<br>cagagatgaccgccaccgagggcgccatcgtgcagatcaattgcacctaccagaccagcggc<br>ttcaacggcctgttctggtatcagcagcatgccggcgaggcccctaccttcctgagctacaa<br>tgtgctggacggcctggaagagaagggcagattcagcagcttcctgtccagaagcaagggct<br>acagctacctgctgctgaaagaactgcagatgaaggacagcgcctcctacctgtgcgccgtt<br>agagattgggatacggcggagccaccaacaagctgatcttttggcacaggcacactgctggc<br>cgtgcagcctaatatccagaatccggagcctgccgtgtaccagctgaAATATCCAGAATCCG<br>GACCcgcggtatatcaactgcgcgactcaaaatcatccgataagagtgtctgtttgtttac<br>tgacttcgacagtcaaactaatgtctctcagagcaaagattccgatgtctacatcactgaca<br>agtgcgttctggatatgcggagcatggattttaagtccaactccgccgtagcctggtccaac<br>aagtcagactttgcctgtgcaaatgctttcaacaactcaattatccctgaggacacttctt<br>tccttcaccggagtcctcatgcgatgttaaactggtcgaaaaatcttttgagacggatacga<br>acctcaacttccaaaatttgagcgttattggctttaggattctgcttctcaaggttgcgggg<br>ttcaatctcctgatgacgttgcggctttggagcagctaa | TCR 56 Alpha Codon-Optimized with Codon Optimized Human Constant (nt) |
| 4 | atggctcaagagctgggcatgcagtgtcaggccagaggaatcctgcagcagatgtggggagt<br>gttcctgctgtacgtgtccatgaagatgggcggcaccaccggccagaacatcgatcagccta<br>cagagatgaccgccaccgagggcgccatcgtgcagatcaattgcacctaccagaccagcggc<br>ttcaacggcctgttctggtatcagcagcatgccggcgaggcccctaccttcctgagctacaa<br>tgtgctggacggcctggaagagaagggcagattcagcagcttcctgtccagaagcaagggct<br>acagctacctgctgctgaaagaactgcagatgaaggacagcgcctcctacctgtgcgccgtt<br>agagattgggatacggcggagccaccaacaagctgatctttggcacaggcacactgctggc<br>cgtgcagcctaatatccagaatccggagcctgccgtgtaccagctgaAATATCCAGAATCCG<br>GAGCCTGCCGTGTACCAGCTGAAGGACCCACGGAGCCAGGATAGCACCCTGTGCCTGTTCAC<br>CGACTTTGATTCTCAGATCAACGTGCCCAAGACCATGGAGAGCGGCACCTTCATCACAGACA<br>AGTGCGTGCTGGATATGAAGGCCATGGACAGCAAGTCCAACGGCGCCATCGCCTGGTCCAAT<br>CAGACATCTTTCACCTGCCAGGATATCTTTAAGGAGACAAATGCCACCTATCCTTCCTCTGA<br>CGTGCCATGTGATGCCACCCTGACAGAAGAGCTTCGAGACCGACATGAACCTGAATTTTC<br>AGAATCTGCTCGTGATTGTCCTGAGAATCCTGCTGCTGAAGGTGGCCGGCTTTAACCTGCTG<br>ATGACCCTGAGGCTGTGGAGCTCCTGA | TCR 56 Alpha Codon-Optimized with Codon Optimized Mouse Constant (nt) |
| 5 | GQNIDQPTEMTATEGAIVQINCTYQTSGFNGLFWYQQHAGEAPTFLSYNVLDGLEEKGRFSS<br>FLSRSKGYSYLLLKELQMKDSASYLCAVRDWGYGGATNKLIFGTGTLLAVQPNIQNPDPAVY<br>QLRDSKSSDKSVCLFTDFDSQTNVSQSKDSDVYITDKCVLDMRSMDFKSNSAVAWSNKSDFA<br>CANAFNNSIIPEDTFFPSPESSCDVKLVEKSFETDTNLNFQNLSVIGFRILLLKVAGFNLLM<br>TLRLWSS | TCR 56 Alpha with Codon Optimized Human Constant (aa) |
| 6 | GQNIDQPTEMTATEGAIVQINCTYQTSGFNGLFWYQQHAGEAPTFLSYNVLDGLEEKGRFSS<br>FLSRSKGYSYLLLKELQMKDSASYLCAVRDWGYGGATNKLIFGTGTLLAVQPNIQNPEPAVY<br>QLKDPRSQDSTLCLFTDFDSQINVPKTMESGTFITDKCVLDMKAMDSKSNGAIAWSNQTSFT<br>CQDIFKETNATYPSSDVPCDATLTEKSFETDMNLNFQNLLVIVLRILLLKVAGFNLLMTLRL<br>WSS | TCR 56 Alpha with Codon Optimized Mouse Constant (aa) |

SEQUENCE TABLE

| SEQ ID NO | SEQUENCE | Description |
|---|---|---|
| 7 | MAQELGMQCQARGILQQMWGVFLLYVSMKMGGTTGQNIDQPTEMTATEGAIVQINCTYQTSG FNGLFWYQQHAGEAPTFLSYNVLDGLEEKGRFSSFLSRSKGYSYLLLKELQMKDSASYLCAV RDWGYGGATNKLIFGTGTLLAVQPNIQNPDPAVYQLRDSKSSDKSVCLFTDFDSQTNVSQSK DSDVYITDKCVLDMRSMDFKSNSAVAWSNKSDFACANAFNNSIIPEDTFFPSPESSCDVKLV EKSFETDTNLNFQNLSVIGFRILLLKVAGFNLLMTLRLWSS | TCR 56 Alpha with Codon Optimized Human Constant and signal peptide (aa) |
| 8 | MAQELGMQCQARGILQQMWGVFLLYVSMKMGGTTGQNIDQPTEMTATEGAIVQINCTYQTSG FNGLFWYQQHAGEAPTFLSYNVLDGLEEKGRFSSFLSRSKGYSYLLLKELQMKDSASYLCAV RDWGYGGATNKLIFGTGTLLAVQPNIQNPEPAVYQLKDPRSQDSTLCLFTDFDSQINVPKTM ESGTFITDKCVLDMKAMDSKSNGAIAWSNQTSFTCQDIFKETNATYPSSDVPCDATLTEKSF ETDMNLNFQNLLVIVLRILLLKVAGFNLLMTLRLWSS | TCR 56 Alpha with Codon Optimized Mouse Constant and signal peptide (aa) |
| 9 | GQNIDQPTEMTATEGAIVQINCTYQTSGFNGLFWYQQHAGEAPTFLSYNVLDGLEEKGRFSS FLSRSKGYSYLLLKELQMKDSASYLCAVRDWGYGGATNKLIFGTGTLLAVQP | TCR 56 Alpha variable region (aa) |
| 10 | TSGFNG | TCR 56 Alpha CDR1 (aa) |
| 11 | NVLDGL | TCR 56 Alpha CDR2 (aa) |
| 12 | AVRDWGYGGATNKLI | TCR 56 Alpha CDR3 (aa) |
| 13 | MAQELGMQCQARGILQQMWGVFLLYVSMKMGGTT | TCR 56 Alpha Signal peptide (aa) |
| 14 | NIQNPDPAVYQLRDSKSSDKSVCLFTDFDSQTNVSQSKDSDVYITDKCVLDMRSMDFKSNSA VAWSNKSDFACANAFNNSIIPEDTFFPSPESSCDVKLVEKSFETDTNLNFQNLSVIGFRILL LKVAGFNLLMTLRLWSS | Alpha Human constant region (aa) |
| 15 | NIQNPEPAVYQLKDPRSQDSTLCLFTDFDSQINVPKTMESGTFITDKCVLDMKAMDSKSNGA IAWSNQTSFTCQDIFKETNATYPSSDVPCDATLTEKSFETDMNLNFQNLLVIVLRILLLKVA GFNLLMTLRLWSS | Alpha Mouse constant region (aa) |
| 16 | ATGGCCAACTCTGCTATGGACACCAGAGTACTCTGCTGTGCGGTCATCTGTCTTCTGGGGGC AGGTCTCTCAAATGCCGGCGTCATGCAGAACCCAAGACACCTGGTCAGGAGGAGGGGACAGG AGGCAAGACTGAGATGCAGCCCAATGAAAGGACACAGTCATGTTTACTGGTATCGGCAGCTC CCAGAGGAAGGTCTGAAATTCATGGTTTATCTCCAGAAAGAAAATATCATAGATGAGTCAGG AATGCCAAAGGAACGATTTTCTGCTGAATTTCCCAAAGAGGGCCCCAGCATCCTGAGGATCC AGCAGGTAGTGCGAGGAGATTCGGCAGCTTATTTCTGTGCCAGCTCACCAGACGAAAGCAGG GATAGCAATCAGCCCCAGCATTTTGGTGATGGGACTCGACTCTCCATCCTAgaggacctgaa taaggtgttccccctgaggtggccgtgtttgagccaagcgaggccgagatctcccacaccc agaaggccacccctggtgtgcctggcaaccggcttcttttcccgatcacgtggagctgcctgg tgggtgaacggcaaggaggtgcactctggcgtgtgcacagacccacagccctgaaggagca gcctgccctgaatgattcccgctattgtctgtcctctcggctgagagtgtctgccaccttt ggcagaacccacggaatcacttcagatgccaggtgcagttttacggcctgtctgagaacgac gagtggacccaggatcgggccaagcctgtgacacagatcgtgagcgcggaagcatggggcag agccgactgtggcttcaccagcgtgtcctatcagcagggcgtgctgtccgccaccatcctgt acgagatcctgctgggcaaggccacactgtatgccgtgctggtgtctgccctggtgctgatg gccatggtgaagagaaaagacttctaa | TCR 56 Beta Native with Codon Optimized Human Constant (nt) |
| 17 | ATGGCCAACTCTGCTATGGACACCAGAGTACTCTGCTGTGCGGTCATCTGTCTTCTGGGGGC AGGTCTCTCAAATGCCGGCGTCATGCAGAACCCAAGACACCTGGTCAGGAGGAGGGGACAGG AGGCAAGACTGAGATGCAGCCCAATGAAAGGACACAGTCATGTTTACTGGTATCGGCAGCTC CCAGAGGAAGGTCTGAAATTCATGGTTTATCTCCAGAAAGAAAATATCATAGATGAGTCAGG AATGCCAAAGGAACGATTTTCTGCTGAATTTCCCAAAGAGGGCCCCAGCATCCTGAGGATCC AGCAGGTAGTGCGAGGAGATTCGGCAGCTTATTTCTGTGCCAGCTCACCAGACGAAAGCAGG GATAGCAATCAGCCCCAGCATTTTGGTGATGGGACTCGACTCTCCATCCTAGAGGACCTGCG CAATGTGACCCCCCCTAAGGTGTCCCTGTTTGAGCCCTCTAAGGCCGAGATCGCCAACAAGC AGAAGGCCACCCTGGTGTGCCTGGCCAGAGGCTTCTTCCCTGATCACGTGGAGCTGAGCTGG TGGGTGAATGGCAAGGAGGTGCACTCCGGCGTGTGCACCGACCCACAGGCCTACAAGGAGTC CAACTACTCTTATTGTCTGTCCTCTAGGCTGCGCGTGAGCGCCACATTCTGGCACAACCCTC GGAATCACTTCAGATGCCAGGTGCAGTTTCACGGCCTGAGCGAGGAGGATAAGTGGCCAGAG GGCTCCCCAAAGCCCGTGACCCAGAATATCTCTGCCGAGGCATGGGGCAGGGCCGACTGTGG | TCR 56 Beta Native with Codon Optimized Mouse Constant (nt) |

SEQUENCE TABLE

| SEQ ID NO | SEQUENCE | Description |
|---|---|---|
| | AATCACCTCCGCCTCTTATCAGCAGGGCGTGCTGTCCGCCACAATCCTGTACGAGATCCTGC<br>TGGGCAAGGCCACCCTGTATGCCGTGCTGGTGTCCACACTGGTGGTCATGGCCATGGTGAAG<br>CGCAAGAACAGCtaa | |
| 18 | atgggacccatggccaatagcgccatggataccagagtgctgtgctgcgccgtgatctgtct<br>gcttggagccggactgtctaatgccggcgtgatgcagaacccagacacctcgttcggagaa<br>gaggccaagaggccagactgagatgcagccctatgaagggccacagccacgtgtactggtac<br>agacagctgcctgaagagggcctgaagttcatggtgtacctgcagaaagagaacatcatcga<br>cgagagcggcatgcccaaagagcggttctctgccgagtttcccaaagagggccccagcatcc<br>tgagaatccagcaggttgtgcgggagatagcgccgcctacttttgtgccagctctcccgat<br>gagagccgggactctaatcagcctcagcactttggcgacggcaccaggctgtctattctcga<br>ggacctgaataaggtgttcccccctgaggtggccgtgtttgagccaagcgaggccgagatct<br>cccacacccagaaggccaccctggtgtgcctggcaaccggcttctttcccgatcacgtggag<br>ctgtcctggtgggtgaacggcaaggaggtgcactctggcgtgtgcacagacccacagcccct<br>gaaggagcagcctgccctgaatgattcccgctattgtctgtcctctcggctgagagtgtctg<br>ccaccttttggcagaaccacggaatcacttcagatgccagtgcagtttacggcctgtct<br>gagaacgacgagtggacccaggatcgggccaagcctgtgacacagatcgtgagcgcggaagc<br>atggggcagagccgactgtggcttcaccagcgtgtcctatcagcagggcgtgctgtccgcca<br>ccatcctgtacgagatcctgctgggcaaggccacactgtatgccgtgctggtgtctgccctg<br>gtgctgatggccatggtgaagagaaaagacttctaa | TCR 56 Beta Codon-Optimized with Codon Optimized Human Constant (nt) |
| 19 | atgggacccatggccaatagcgccatggataccagagtgctgtgctgcgccgtgatctgtct<br>gcttggagccggactgtctaatgccggcgtgatgcagaacccagacacctcgttcggagaa<br>gaggccaagaggccagactgagatgcagccctatgaagggccacagccacgtgtactggtac<br>agacagctgcctgaagagggcctgaagttcatggtgtacctgcagaaagagaacatcatcga<br>cgagagcggcatgcccaaagagcggttctctgccgagtttcccaaagagggccccagcatcc<br>tgagaatccagcaggttgtgcgggagatagcgccgcctacttttgtgccagctctcccgat<br>gagagccgggactctaatcagcctcagcactttggcgacggcaccaggctgtctattctcGA<br>GGACCTGCGCAATGTGACCCCCCCTAAGGTGTCCCTGTTTGAGCCCAGCAAGGCCGAGATCG<br>CCAACAAGCAGAAGGCCACCCTGGTGTGCCTGGCCAGAGGCTTCTTCCCTGATCACGTGGAG<br>CTGAGCTGGTGGGTGAATGGCAAGGAGGTGCACTCCGGCGTGTGCACCGACCCACAGGCCTA<br>CAAGGAGTCCAACTACTCTTATTGTCTGTCCTCTAGGCTGCGCGTGAGCGCCACATTCTGGC<br>ACAACCCTCGGAATCACTTCAGATGCCAGGTGCAGTTTCACGGCCTGAGCGAGGAGGATAAG<br>TGGCCAGAGGGCTCCCCAAAGCCCGTGACCCAGAATATCTCTGCCGAGGCATGGGGCAGGGC<br>CGACTGTGGAATCACCTCCGCCTCTTATCAGCAGGGCGTGCTGTCCGCCACAATCCTGTACG<br>AGATCCTGCTGGGCAAGGCCACCCTGTATGCCGTGCTGGTGTCCACACTGGTGGTCATGGCC<br>ATGGTGAAGCGCAAGAACAGCtaa | TCR 56 Beta Codon-Optimized with Codon Optimized Mouse Constant (nt) |
| 20 | NAGVMQNPRHLVRRRGQEARLRCSPMKGHSHVYWYRQLPEEGLKFMVYLQKENIIDESGMPK<br>ERFSAEFPKEGPSILRIQQVVRGDSAAYFCASSPDESRDSNQPQHFGDGTRLSILEDLNKVF<br>PPEVAVFEPSEAEISHTQKATLVCLATGFFPDHVELSWWVNGKEVHSGVCTDPQPLKEQPAL<br>NDSRYCLSSRLRVSATFWQNPRNHFRCQVQFYGLSENDEWTQDRAKPVTQIVSAEAWGRADC<br>GFTSVSYQQGVLSATILYEILLGKATLYAVLVSALVLMAMVKRKDF | TCR 56 Beta with Codon Optimized Human Constant (aa) |
| 21 | NAGVMQNPRHLVRRRGQEARLRCSPMKGHSHVYWYRQLPEEGLKFMVYLQKENIIDESGMPK<br>ERFSAEFPKEGPSILRIQQVVRGDSAAYFCASSPDESRDSNQPQHFGDGTRLSILEDLRNVT<br>PPKVSLFEPSKAEIANKQKATLVCLARGFFPDHVELSWWVNGKEVHSGVCTDPQAYKESNYS<br>YCLSSRLRVSATFWHNPRNHFRCQVQFHGLSEEDKWPEGSPKPVTQNISAEAWGRADCGITS<br>ASYQQGVLSATILYEILLGKATLYAVLVSTLVVMAMVKRKNS | TCR 56 Beta with Codon Optimized Mouse Constant (aa) |
| 22 | MANSAMDTRVLCCAVICLLGAGLSNAGVMQNPRHLVRRRGQEARLRCSPMKGHSHVYWYRQL<br>PEEGLKFMVYLQKENIIDESGMPKERFSAEFPKEGPSILRIQQVVRGDSAAYFCASSPDESR<br>DSNQPQHFGDGTRLSILEDLNKVFPPEVAVFEPSEAEISHTQKATLVCLATGFFPDHVELSW<br>WVNGKEVHSGVCTDPQPLKEQPALNDSRYCLSSRLRVSATFWQNPRNHFRCQVQFYGLSEND<br>EWTQDRAKPVTQIVSAEAWGRADCGFTSVSYQQGVLSATILYEILLGKATLYAVLVSALVLM<br>AMVKRKDF | TCR 56 Beta with Codon Optimized Human Constant and signal peptide (aa) |
| 23 | MANSAMDTRVLCCAVICLLGAGLSNAGVMQNPRHLVRRRGQEARLRCSPMKGHSHVYWYRQL<br>PEEGLKFMVYLQKENIIDESGMPKERFSAEFPKEGPSILRIQQVVRGDSAAYFCASSPDESR<br>DSNQPQHFGDGTRLSILEDLRNVTPPKVSLFEPSKAEIANKQKATLVCLARGFFPDHVELSW<br>WVNGKEVHSGVCTDPQAYKESNYSYCLSSRLRVSATFWHNPRNHFRCQVQFHGLSEEDKWPE<br>GSPKPVTQNISAEAWGRADCGITSASYQQGVLSATILYEILLGKATLYAVLVSTLVVMAMVK<br>RKNS | TCR 56 Beta with Codon Optimized Mouse Constant and signal peptide (aa) |
| 24 | NAGVMQNPRHLVRRRGQEARLRCSPMKGHSHVYWYRQLPEEGLKFMVYLQKENIIDESGMPK<br>ERFSAEFPKEGPSILRIQQVVRGDSAAYFCASSPDESRDSNQPQHFGDGTRLSIL | TCR 56 Beta variable region (aa) |
| 25 | KGHSH | TCR 56 Beta CDR1 (aa) |

SEQUENCE TABLE

| SEQ ID NO | SEQUENCE | Description |
|---|---|---|
| 26 | LQKENI | TCR 56 Beta CDR2 (aa) |
| 27 | ASSPDESRDSNQPQH | TCR 56 Beta CDR3 (aa) |
| 28 | MANSAMDTRVLCCAVICLLGAGLS | TCR 56 Beta signal peptide (aa) |
| 29 | EDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF | Beta human constant region (aa) |
| 30 | EDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS | Beta mouse constant region (aa) |
| 31 | ggctccggagcaaccaatttcagcctgctgaagcaggccggcgatgtggaggagaatcctggccca | P2A (nt) |
| 32 | GSGATNFSLLKQAGDVEENPGP | P2A (aa) |
| 33 | gaggacctgaataaggtgttccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaAATATCCAGAATCCGGACCCcgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa | TCR 56 Native full sequence with human constant (nt) |
| 34 | ATGGCCAACTCTGCTATGGACACCAGAGTACTCTGCTGTGCGGTCATCTGTCTTCTGGGGGCAGGTCTCTCAAATGCCGGCGTCATGCAGAACCCAAGACACCTGGTCAGGAGGAGGGGACAGGAGGCAAGACTGAGATGCAGCCCAATGAAAGGACACAGTCATGTTTACTGGTATGCGGCAGCTCCCAGAGGAAGGTCTGAAATTCATGGTTTATCTCCAGAAAGAAAATATCATAGATGAGTCAGGAATGCCAAAGGAACGATTTTCTGCTGAATTTCCCAAAGAGGGCCCCAGCATCCTGAGGATCCAGCAGGTAGTGCGAGGAGATTCGGCAGCTTATTTCTGTGCCAGCTCACCAGACGAAAGCAGGGATAGCAATCAGCCCCAGCATTTTGGTGATGGGACTCGACTCTCCATCCTAGAGGACCTGCCAATGTGACCCCCCCTAAGGTGTCCCTGTTTGAGCCCTCTAAGGCCGAGATCGCCAACAAGCAGAAGGCCACCCTGGTGTGCCTGGCCAGAGGCTTCTTCCCTGATCACGTGGAGCTGAGCTGGTGGGTGAATGGCAAGGAGGTGCACTCCGGCGTGTGCACCGACCCACAGGCCTACAAGGAGTCCAACTACTCTTATTGTCTGTCCTCTAGGCTGCGCGTGAGCGCCACATTCTGGCACAACCCTCGGAATCACTTCAGATGCCAGGTGCAGTTTCACGGCCTGAGCGAGGAGGATAAGTGGCCAGAGGGCTCCCCAAAGCCCGTGACCCAGAATATCTCTGCCGAGGCATGGGGCAGGGCCGACTGTGGAATCACCTCCGCCTCTTATCAGCAGGGCGTGCTGTCCGCCACAATCCTGTACGAGATCCTGCTGGGCAAGGCCACCCTGTATGCCGTGCTGGTGTCCACACTGGTGGTCATGGCCATGGTGAAGCGCAAGAACAGCtaaggctccggagcaaccaatttcagcctgctgaagcaggccggcgatgtggaggagaatcctggcccaATGGCTCAGGAACTGGGAATGCAGTGCCAGGTCGTGGTATCCTGCAGCAGATGTGGGAGTTTTCCTTCTTTATGTTTCCATGAAGATGGGAGGCACTACAGGACAAAACATTGACCAGCCCACTGAGATGACAGCTACGGAAGGTGCCATTGTCCAGATCAACTGCACGTACCAGACATCTGGGTTCAACGGGCTGTTCTGGTACCAGCACATGCTGGCGAAGCACCCACATTTCTGTCTTACAATGTTCTGGATGGTTTGGAGGAGAAAGGTCGTTTTCTTCATTCCTTAGTCGGTCTAAAGGGTACAGTTACCTCCTTTTGAAGGAGCTCCAGATGAAAGACTCTGCCTCTTACCTCTGTGCTGTGAGAGATTGGGGATATGGTGGTGCTACAAACAAGCTCATCTTTGGAACTGGCACTCTGCTTGCTGTCCAGCCAAATATCCAGAATCCGGAGCCTGCCGTGTACCAGCTGAAGGACCCACGGAGCCAGGATAGCACCCTGTGCCTGTTCACCGACTTTGATTCTCAGATCAACGTGCCCAAGACCATGGAGAGCGGCACCTTCATCACAGACAAGTGCGTGCTGGATATGAAGGCCATGGACAGCAAGTCCAACGGCGCCATCGCCTGGTCCAATCAGACATCTTTCACCTGCCAGGATATCTTTAAGGAGACAAATGCCACCTATCCTTCCTCTGACGTGCCATGTGATGCCACCCTGACAGAGAAGAGCTTCGAGACCGACATGAACCTGAATTTTCAGAATCTGCTCGTGATTGTCCTGAGAATCCTGCTGCTGAAGGTGGCCGGCTTTAACCTGCTGATGACCCTGAGGCTGTGGAGCTCCTGA | TCR 56 Native full sequence with mouse constant (nt) |

SEQUENCE TABLE

| SEQ ID NO | SEQUENCE | Description |
|---|---|---|
| 35 | atgggacccatggccaatagcgccatggataccagagtgctgtgctgcgccgtgatctgtct gcttggagccggactgtctaatgccggcgtgatgcagaacccagacacctcgttcggagaa gaggccaagaggccagactgagatgcagccctatgaagggccacagccacgtgtactggtac agacagctgcctgaagagggcctgaagttcatggtgtacctgcagaaagagaacatcatcga tgagaatccagcaggttgtgcgggagatagcgccgcctactttgtgccagctctcccgat gagagccgggactctaatcagcctcagcactttggcgacggcaccaggctgtctattctcga ggacctgaataaggtgttccccctgaggtggccgtgtttgagccaagcgaggccgagatct cccacacccagaaggccaccctggtgtgcctggcaacggcttctttcccgatcacgtggag ctgtcctggtgggtgaacggcaaggaggtgcactctggcgtgtgcacagacccacagcccct gaaggagcagcctgccctgaatgattcccgctattgtctgtcctctcggctgagagtgtctg ccacctttggcagaacccacggaatcacttcagatgccaggtgcagttttacggctgtct gagaacgacgagtggacccaggatcgggccaagcctgtgacacagatcgtgagcgcggaagc atggggcagagccgactgtggcttcaccagcgtgtcctatcagcagggcgtgctgtccgcca ccatcctgtacgagatcctgctgggcaaggccacactgtatgccgtgctggtgtctgccctg gtgctgatggccatggtgaagagaaaagacttctaaggctccggagcaaccaatttcagcct gctgaagcaggccgcgatgtggaggagaatcctggcccaatggctcaagagctgggcatgc agtgtcaggcagaggaatcctgcagcagatgtgggagtgttcctgctgtacgtgtccatg aagatgggcggcaccaccggccagaacatcgatcagcctacagagatgaccgccaccgaggg cgccatcgtgcagatcaattgcacctaccagaccagcggcttcaacggcctgttctggtatc agcagcatgccggcgaggcccctaccttcctgagctacaatgtgctggacggcctggaagag aagggcagattcagcagcttcctgtccagaagcaagggctacagcacctgctgctgaaaga actgcagatgaaggacagcgcctcctacctgtgcgccgttagagattgggatacggcggag ccaccaacaagctgatctttggcacaggcacactgctggccgtgcagcctaatatccagaat ccggagcctgccgtgtaccagctgaAATATCCAGAATCCGGACCcgcgcgtatatcaactgc gcgactcaaaatcatccgataagagtgtctgtttgtttactgacttcgacagtcaaactaat gtctctcagagcaaagattccgatgtctacatcactgacaagtgcgttctggatatgcggag catggattttaagtccaactccgccgtagcctggtccaacaagtcagacttgcctgtgcaa atgctttcaacaactcaattatccctgaggacactttcttccttcaccggagtcctcatgc gatgttaaactggtcgaaaaatctttgagacggatacgaacctcaacttccaaaatttgag cgttattggctttaggattctgcttctcaaggttgcggggttcaatctcctgatgacgttgc ggctttggagcagctaa | TCR 56 Codon-optimized full sequence with (nt) |
| 36 | atgggacccatggccaatagcgccatggataccagagtgctgtgctgcgccgtgatctgtct gcttggagccggactgtctaatgccggcgtgatgcagaacccagacacctcgttcggagaa gaggccaagaggccagactgagatgcagccctatgaagggccacagccacgtgtactggtac agacagctgcctgaagagggcctgaagttcatggtgtacctgcagaaagagaacatcatcga cgagagcggcatgcccaaagagcggttctctgccgagtttcccaaagagggcccagcatcc tgaatccagcaggttgtgcgggagatagcgccgcctactttgtgccagctctcccgat gagagccgggactctaatcagcctcagcactttggcgacggcaccaggctgtctattctcGA GGACCTGCGCAATGTGACCCCCCCTAAGGTGTCCCTGTTTGAGCCCTCTAAGGCCGAGATCG CCAACAAGCAGAAGGCCACCCTGGTGTGCCTGGCCAGAGGCTTCTTCCCTGATCACGTGGAG CTGAGCTGGTGGGTGAATGGCAAGGAGGTGCACTCCGGCGTGTGCACCGACCCACAGGCCTA CAAGGAGTCCAACTACTCTTATTGTCTGTCCTCTAGGCTGCGCGTGAGCGCCACATTCTGGC ACAACCCTCGGAATCACTTCAGATGCCAGGTGCAGTTTCACGGCCTGAGCGAGGAGGATAAG TGGCCAGAGGGCTCCCCAAAGCCCGTGACCCAGAATATCTCTGCCGAGGCATGGGGCAGGGC CGACTGTGGAATCACCTCCGCCTCTTATCAGCAGGGCGTGCTGTCCGCCACAATCCTGTACG AGATCCTGCTGGGCAAGGCCACCCTGTATGCCGTGCTGGTGTCCACACTGGTGGTCATGGCC ATGGTGAAGCGCAAGAACAGCtaaggctccggagcaaccaatttcagcctgctgaagcaggc cggcgatgtggaggagaatcctggcccaatggctcaagagctgggcatgcagtgtcaggcca gaggaatcctgcagcagatgtggggagtgttcctgctgtacgtgtccatgaagatgggcggc accaccggccagaacatcgatcagcctacagagatgaccgccaccgagggcgccatcgtgca gatcaattgcacctaccagaccagcggcttcaacggcctgttctgtatcagcagcatgccgg cgaggcccctaccttcctgagctacaatgtgctggacggcctggaagagaagggcagattc agcagcttcctgtccagaagcaagggctacagcacctgctgctgaaagaactgcagatgaa ggacagcgcctcctacctgtgcgccgttagagattgggatacggcggagccaccaacaagc tgatctttggcacaggcacactgctggccgtgcagcctaatatccagaatccggagcctgcc gtgtaccagctgaAATATCCAGAATCCGGAGCCTGCCGTGTACCAGCTGAAGGACCCACGGA GCCAGGATAGCACCCTGTGCCTGTTCACCGACTTTGATTCTCAGATCAACGTGCCCAAGACC ATGGAGAGCGGCACCTTCATCACAGACAAGTGCGTGCTGGATATGAAGGCCATGGACAGCAA GTCCAACGGCGCCATCGCCTGGTCCAATCAGACATCTTTCACCTGCCAGGATATCTTTAAGG AGACAAATGCCACCTATCCTTCCTCTGACGTGCCATGTGATGCCACCCTGACAGAGAAGAGC TTCGAGACCGACATGAACCTGAATTTTCAGAATCTGCTCGTGATTGTCCTGAGAATCCTGCT GCTGAAGGTGGCCGGCTTTAACCTGCTGATGACCCTGAGGCTGTGGAGCTCCTGA | TCR 56 Codon-optimized full sequence with mouse constant (nt) |
| 37 | MANSAMDTRVLCCAVICLLGAGLSNAGVMQNPRHLVRRRGQEARLRCSPMKGHSHVYWYRQL PEEGLKFMVYLQKENIIDESGMPKERFSAEFPKEGPSILRIQQVVRGDSAAYFCASSPDESR DSNQPQHFGDGTRLSILEDLNKVFPPEVAVFEPSEAEISHTQKATLVCLATGFFPDHVELSW WVNGKEVHSGVCTDPQPLKEQPALNDSRYCLSSRLRVSATFWQNPRNHFRCQVQFYGLSEND EWTQDRAKPVTQIVSAEAWGRADCGFTSVSYQQGVLSATILYEILLGKATLYAVLVSALVLM AMVKRKDFGSGATNFSLLKQAGDVEENPGPMAQELGMQCQARGILQQMWGVFLLYVSMKGG TTGQNIDQPTEMTATEGAIVQINCTYQTSGFNGLFWYQQHAGEAPTFLSYNVLDGLEEKGRF SSFLSRSKGYSYLLLKELQMKDSASYLCAVRDWGYGGATNKLIFGTGTLLAVQPNIQNPDPA | TCR 56 Full sequence with human constant (aa) |

SEQUENCE TABLE

| SEQ ID NO | SEQUENCE | Description |
|---|---|---|
|  | VYQLRDSKSSDKSVCLFTDFDSQTNVSQSKDSDVYITDKCVLDMRSMDFKSNSAVAWSNKSD FACANAFNNSIIPEDTFFPSPESSCDVKLVEKSFETDTNLNFQNLSVIGFRILLLKVAGFNL LMTLRLWSS |  |
| 38 | MANSAMDTRVLCCAVICLLGAGLSNAGVMQNPRHLVRRRGQEARLRCSPMKGHSHVYWYRQL PEEGLKFMVYLQKENIIDESGMPKERFSAEFPKEGPSILRIQQVVRGDSAAYFCASSPDESR DSNQPQHFGDGTRLSILEDLRNVTPPKVSLFEPSKAEIANKQKATLVCLARGFFPDHVELSW WVNGKEVHSGVCTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVSTLVVMAMVK RKNSGSGATNFSLLKQAGDVEENPGPMAQELGMQCQARGILQQMWGVFLLYVSMKMGGTTGQ NIDQPTEMTATEGAIVQINCTYQTSGFNGLFWYQQHAGEAPTFLSNVLDGLEEKGRFSSFL SRSKGYSYLLLKELQMKDSASYLCAVRDWGYGGATNKLIFGTGTLLAVQPNIQNPEPAVYQL KDPRSQDSTLCLFTDFDSQINVPKTMESGTFITDKCVLDMKAMDSKSNGAIAWSNQTSFTCQ DIFKETNATYPSSDVPCDATLTEKSFETDMNLNFQNLLVIVLRILLLKVAGFNLLMTLRLWS S | TCR 56 Full sequence with mouse constant (aa) |
| 39 | ATGGTCCTGAAATTCTCCGTGTCCATTCTTTGGATTCAGTTGGCATGGGTGAGCACCCAGCT GCTGGAGCAGAGCCCTCAGTTTCTAAGCATCCAAGAGGGAGAAAATCTCACTGTGTACTGCA ACTCCTCAAGTGTTTTTTCCAGCTTACAATGGTACAGACAGGAGCCTGGGGAAGGTCCTGTC CTCCTGGTGACAGTAGTTACGGGTGGAGAAGTGAAGAAGCTGAAGAGACTAACCTTTCAGTT TGGTGATGCAAGAAAGGACAGTTCTCTCCACATCACTGCaGCCCAGCCTGGTGATACAGGCC TCTACCTCTGTGCAGGAGCTCGCAACTTCAACAAATTTTACTTTGGATCTGGGACCAAACTC AATGTAAAACCAAATATCCAGAATCCGGACCccgcggtatatcaactgcgcgactcaaaatc atccgataagagtgtctgtttgtttactgacttcgacagtcaaactaatgtctctcagagca aagattccgatgtctacatcactgacaagtgcgttctggatatgcggagcatggattttaag tccaactccgccgtagcctggtccaacaagtcagactttgcctgtgcaaatgcttcaacaa ctcaattatccctgaggacactttctttccttcaccggagtcctcatgcgatgttaaactgg tcgaaaaatcttttgagacggatacgaacctcaacttccaaaatttgagcgttattggcttt aggattctgcttctcaaggttgcgggggttcaatctcctgatgacgttgcggctttggagcag ctaa | TCR 57 Alpha Native with Codon Optimized Human Constant (nt) |
| 40 | ATGGTCCTGAAATTCTCCGTGTCCATTCTTTGGATTCAGTTGGCATGGGTGAGCACCCAGCT GCTGGAGCAGAGCCCTCAGTTTCTAAGCATCCAAGAGGGAGAAAATCTCACTGTGTACTGCA ACTCCTCAAGTGTTTTTTCCAGCTTACAATGGTACAGACAGGAGCCTGGGGAAGGTCCTGTC CTCCTGGTGACAGTAGTTACGGGTGGAGAAGTGAAGAAGCTGAAGAGACTAACCTTTCAGTT TGGTGATGCAAGAAAGGACAGTTCTCTCCACATCACTGCaGCCCAGCCTGGTGATACAGGCC TCTACCTCTGTGCAGGAGCTCGCAACTTCAACAAATTTTACTTTGGATCTGGGACCAAACTC AATGTAAAACCAAATATCCAGAATCCGGAGCCTGCCGTGTACCAGCTGAAGGACCCACGGAG CCAGGATAGCACCCTGTGCCTGTTCACCGACTTTGATTCTCAGATCAACGTGCCCAAGACCA TGGAGAGCGGCACCTTCATCACAGACAAGTGCGTGCTGGATATGAAGGCCATGGACAGCAAG TCCAACGGCGCCATCGCCTGGTCCAATCAGACATCTTTCACCTGCCAGGATATCTTTAAGGA GACAAATGCCACCTATCCTTCCTCTGACGTGCCATGTGATGCCACCCTGACAGAGAAGAGCT TCGAGACCGACATGAACCTGAATTTTCAGAATCTGCTCGTGATTGTCCTGAGAATCCTGCTG CTGAAGGTGGCCGGCTTTAACCTGCTGATGACCCTGAGGCTGTGGAGCTCCTGA | TCR 57 Alpha Native with Codon Optimized Mouse Constant (nt) |
| 41 | ATGGTGCTGAAGTTTTCTGTGAGCATCCTGTGGATTCAGCTGGCCTGGGTGTCCACCCAGCT CCTGGAGCAGAGCCCCCAGTTCCTGTCCATCCAGGAGGGCGAGAACCTGACCGTGTACTGCA ACAGCTCTTCTGTCTTTTCATCACTGCAGTGGTATAGACAAGAACCGGGTGAAGGTCCAGTT CTGCTGGTGACCGTCGTCACCGGCGGCGAGGTGAAGAAGCTAAAGCGCCTGACGTTCCAGTT CGGAGACGCGCGGAAGGACTCGTCGCTGCACATCACCGCCGCCCAGCCCGGCGACACCGGCC TGTACCTGTGCGCTGGCGCGCGCAACTTCAACAAGTTCTACTTCGGCAGCGGCACCAAGCTG AACGTGAAACCGAATATCCAGAATCCGGACCccgcggtatatcaactgcgcgactcaaaatc atccgataagagtgtctgtttgtttactgacttcgacagtcaaactaatgtctctcagagca aagattccgatgtctacatcactgacaagtgcgttctggatatgcggagcatggattttaag tccaactccgccgtagcctggtccaacaagtcagactttgcctgtgcaaatgcttcaacaa ctcaattatccctgaggacactttctttccttcaccggagtcctcatgcgatgttaaactgg tcgaaaaatcttttgagacggatacgaacctcaacttccaaaatttgagcgttattggcttt aggattctgcttctcaaggttgcgggggttcaatctcctgatgacgttgcggctttggagcag ctaa | TCR 57 Alpha Codon-Optimized with Codon Optimized Human Constant (nt) |
| 42 | ATGGTGCTGAAGTTTTCTGTGAGCATCCTGTGGATTCAGCTGGCCTGGGTGTCCACCCAGCT CCTGGAGCAGAGCCCCCAGTTCCTGTCCATCCAGGAGGGCGAGAACCTGACCGTGTACTGCA ACAGCTCTTCTGTCTTTTCATCACTGCAGTGGTATAGACAAGAACCGGGTGAAGGTCCAGTT CTGCTGGTGACCGTCGTCACCGGCGGCGAGGTGAAGAAGCTAAAGCGCCTGACGTTCCAGTT CGGAGACGCGCGGAAGGACTCGTCGCTGCACATCACCGCCGCCCAGCCCGGCGACACCGGCC TGTACCTGTGCGCTGGCGCGCGCAACTTCAACAAGTTCTACTTCGGCAGCGGCACCAAGCTG AACGTGAAACCGAATATCCAGAATCCGGAGCCTGCCGTGTACCAGCTGAAGGACCCACGGAG CCAGGATAGCACCCTGTGCCTGTTCACCGACTTTGATTCTCAGATCAACGTGCCCAAGACCA TGGAGAGCGGCACCTTCATCACAGACAAGTGCGTGCTGGATATGAAGGCCATGGACAGCAAG TCCAACGGCGCCATCGCCTGGTCCAATCAGACATCTTTCACCTGCCAGGATATCTTTAAGGA GACAAATGCCACCTATCCTTCCTCTGACGTGCCATGTGATGCCACCCTGACAGAGAAGAGCT TCGAGACCGACATGAACCTGAATTTTCAGAATCTGCTCGTGATTGTCCTGAGAATCCTGCTG CTGAAGGTGGCCGGCTTTAACCTGCTGATGACCCTGAGGCTGTGGAGCTCCTGA | TCR 57 Alpha Codon-Optimized with Codon Optimized Mouse Constant (nt) |

| SEQ ID NO | SEQUENCE | Description |
|---|---|---|
| 43 | TQLLEQSPQFLSIQEGENLTVYCNSSSVFSSLQWYRQEPGEGPVLLVTVVTGGEVKKLKRLT FQFGDARKDSSLHITAAQPGDTGLYLCAGARNFNKFYFGSGTKLNVKPNIQNPDPAVYQLRD SKSSDKSVCLFTDFDSQTNVSQSKDSDVYITDKCVLDMRSMDFKSNSAVAWSNKSDFACANA FNNSIIPEDTFFPSPESSCDVKLVEKSFETDTNLNFQNLSVIGFRILLLKVAGFNLLMTLRL WSS | TCR 57 Alpha with Codon Optimized Human Constant (aa) |
| 44 | TQLLEQSPQFLSIQEGENLTVYCNSSSVFSSLQWYRQEPGEGPVLLVTVVTGGEVKKLKRLT FQFGDARKDSSLHITAAQPGDTGLYLCAGARNFNKFYFGSGTKLNVKPNIQNPEPAVYQLKD PRSQDSTLCLFTDFDSQINVPKTMESGTFITDKCVLDMKAMDSKSNGAIAWSNQTSFTCQDI FKETNATYPSSDVPCDATLTEKSFETDMNLNFQNLLVIVLRILLLKVAGFNLLMTLRLWSS | TCR 57 Alpha with Codon Optimized Mouse Constant (aa) |
| 45 | MVLKFSVSILWIQLAWVSTQLLEQSPQFLSIQEGENLTVYCNSSSVFSSLQWYRQEPGEGPV LLVTVVTGGEVKKLKRLTFQFGDARKDSSLHITAAQPGDTGLYLCAGARNFNKFYFGSGTKL NVKPNIQNPDPAVYQLRDSKSSDKSVCLFTDFDSQTNVSQSKDSDVYITDKCVLDMRSMDFK SNSAVAWSNKSDFACANAFNNSIIPEDTFFPSPESSCDVKLVEKSFETDTNLNFQNLSVIGF RILLLKVAGFNLLMTLRLWSS | TCR 57 Alpha with Codon Optimized Human Constant and signal peptide (aa) |
| 46 | MVLKFSVSILWIQLAWVSTQLLEQSPQFLSIQEGENLTVYCNSSSVFSSLQWYRQEPGEGPV LLVTVVTGGEVKKLKRLTFQFGDARKDSSLHITAAQPGDTGLYLCAGARNFNKFYFGSGTKL NVKPNIQNPEPAVYQLKDPRSQDSTLCLFTDFDSQINVPKTMESGTFITDKCVLDMKAMDSK SNGAIAWSNQTSFTCQDIFKETNATYPSSDVPCDATLTEKSFETDMNLNFQNLLVIVLRILL LKVAGFNLLMTLRLWSS | TCR 57 Alpha with Codon Optimized Mouse Constant and signal peptide (aa) |
| 47 | TQLLEQSPQFLSIQEGENLTVYCNSSSVFSSLQWYRQEPGEGPVLLVTVVTGGEVKKLKRLT FQFGDARKDSSLHITAAQPGDTGLYLCAGARNFNKFYFGSGTKLNVKP | TCR 57 Alpha variable region (aa) |
| 48 | SVFSS | TCR 57 Alpha CDR1 (aa) |
| 49 | VVTGGEV | TCR 57 Alpha CDR2 (aa) |
| 50 | AGARNFNKFY | TCR 57 Alpha CDR3 (aa) |
| 51 | MVLKFSVSILWIQLAWVS | TCR 57 Alpha Signal peptide (aa) |
| 52 | ATGCTGCTGCTTCTGCTGCTTCTGGGGCCAGGCTCCGGGCTTGGTGCTGTCGTCTCTCAACA TCCGAGCTGGGTTATCTGTAAGAGTGGAACCTCTGTGAAGATCGAGTGCCGTTCCCTGGACT TTCAGGCCACAACTATGTTTTGGTATCGTCAGTTCCCGAAACAGAGTCTCATGCTGATGGCA ACTTCCAATGAGGGCTCCAAGGCCACATACGAGCAAGGCGTCGAGAAGGACAAGTTTCTCAT CAACCATGCAAGCCTGACCTTGTCCACTCTGACAGTGACCAGTGCCCATCCTGAAGACAGCA GCTTCTACATCTGCAGTGCTAGATCTTGGCGGGGGGGCCTTGAGCAGTTCTTCGGGCCAGGG ACACGGCTCACCGTGCTAgaggacctgaataaggtgttccccctgaggtggcgtgtttga gccaagcgaggccgagatctcccacacccagaaggccaccctggtgtgcctggcaaccggct tctttcccgatcacgtggagctgtcctggtgggtgaacggcaaggaggtgcactctggcgtg tgcacagaccacagcccctgaaggagcagcctgccctgaatgattcccgctattgtctgtc ctctcggctgagagtgtctgccaccttttggcagaacccacggaatcacttcagatgccagg tgcagttttacggcctgtctgagaacgacgagtggaccaggatcgggccaagcctgtgaca cagatcgtgagcgcggaagcatggggcagagcctgactgtggcttcaccagcgtgtcctatca gcagggcgtgctgtccgccaccatcctgtacgagatcctgctgggcaaggccacactgtatg ccgtgctggtgtctgccctggtgctgatggccatggtgaagagaaaagacttctaa | TCR 57 Beta Native with Codon Optimized Human Constant (nt) |
| 53 | ATGCTGCTGCTTCTGCTGCTTCTGGGGCCAGGCTCCGGGCTTGGTGCTGTCGTCTCTCAACA TCCGAGCTGGGTTATCTGTAAGAGTGGAACCTCTGTGAAGATCGAGTGCCGTTCCCTGGACT TTCAGGCCACAACTATGTTTTGGTATCGTCAGTTCCCGAAACAGAGTCTCATGCTGATGGCA ACTTCCAATGAGGGCTCCAAGGCCACATACGAGCAAGGCGTCGAGAAGGACAAGTTTCTCAT CAACCATGCAAGCCTGACCTTGTCCACTCTGACAGTGACCAGTGCCCATCCTGAAGACAGCA GCTTCTACATCTGCAGTGCTAGATCTTGGCGGGGGGGCCTTGAGCAGTTCTTCGGGCCAGGG ACACGGCTCACCGTGCTAGAGGACCTGCGCAATGTGACCCCCCCTAAGGTGTCCCTGTTTGA GCCCTCTAAGGCCGAGATCGCCAACAAGCAGAAGGCCACCCTGGTGTGCCTGGCCAGAGGCT TCTTCCCTGATCACGTGGAGCTGAGCTGGTGGGTGAATGGCAAGGAGGTGCACTCCGGCGTG TGCACCGACCCACAGGCCTACAAGGAGTCCAACTACTCTTATTGTCTGTCCTCTAGGCTGCG CGTGAGCGCCACATTCTGGCACAACCCTCGGAATCACTTCAGATGCCAGGTGCAGTTTCACG GCCTGAGCGAGGAGGATAAGTGGCCAGAGGGCTCCCCCAAAGCCCGTGACCCAGAATATCTCT | TCR 57 Beta Native with Codon Optimized Mouse Constant (nt) |

| SEQ ID NO | SEQUENCE | Description |
|---|---|---|
| | GCCGAGGCATGGGGCAGGGCCGACTGTGGAATCACCTCCGCCTCTTATCAGCAGGGCGTGCT GTCCGCCACAATCCTGTACGAGATCCTGCTGGGCAAGGCCACCCTGTATGCCGTGCTGGTGT CCACACTGGTGGTCATGGCCATGGTGAAGCGCAAGAACAGCtaa | |
| 54 | ATGCTCCTGCTGCTTCTGCTCCTCGGGCCCGGCAGCGGTCTCGGCGCCGTCGTGTCGCAGCA CCCCGTCGTGGGTGATTTGCAAGAGCGGAACGAGCGTGAAGATCGAGTGCCGCTCGCTCGACT TCCAGGCCACAACCATGTTCTGGTACCGCCAGTTTCCCAAGCAGAGCCTCATGCTGATGGCC ACAAGCAATGAAGGCAGCAAGGCCACTTATGAACAGGGCGTGGAGAAGGACAAGTTTCTGAT CAACCACGCCTCCCTGACCCTGTCCACCCTCACTGTGACCAGCGCCCACCCTGAGGACAGCA GCTTCTACATCTGCAGCGCCCGCAGCTGGAGGGGCGGCCTGGAGCAGTTCTTCGGCCCTGGC ACCCGGCTGACAGTGCTGgaggacctgaataaggtgttcccccctgaggtggccgtgtttga gccaagcgaggccgagatctcccacacccagaaggccaccctggtgtgcctggcaaccggct tctttcccgatcacgtggagctgtcctggtgggtgaacggcaaggaggtgcactctggcgtg tgcacagacccacagcccctgaaggagcagcctgccctgaatgattcccgctattgtctgtc ctctcggctgagagtgtctgccacctttggcagaacccacggaatcacttcagatgccagg tgcagttttacggcctgtctgagaacgacgagtggacccaggatcgggccaagcctgtgaca cagatcgtgagcgcggaagcatggggcagagccgactgtggcttcaccagcgtgtcctatca gcagggcgtgctgtccgccaccatcctgtacgagatcctgctgggcaaggccacactgtatg ccgtgctggtgtctgccctggtgctgatggccatggtgaagagaaaagacttctaa | TCR 57 Beta Codon-Optimized with Codon Optimized Human Constant (nt) |
| 55 | ATGCTCCTGCTGCTTCTGCTCCTCGGGCCCGGCAGCGGTCTCGGCGCCGTCGTGTCGCAGCA CCCCGTCGTGGGTGATTTGCAAGAGCGGAACGAGCGTGAAGATCGAGTGCCGCTCGCTCGACT TCCAGGCCACAACCATGTTCTGGTACCGCCAGTTTCCCAAGCAGAGCCTCATGCTGATGGCC ACAAGCAATGAAGGCAGCAAGGCCACTTATGAACAGGGCGTGGAGAAGGACAAGTTTCTGAT CAACCACGCCTCCCTGACCCTGTCCACCCTCACTGTGACCAGCGCCCACCCTGAGGACAGCA GCTTCTACATCTGCAGCGCCCGCAGCTGGAGGGGCGGCCTGGAGCAGTTCTTCGGCCCTGGC ACCCGGCTGACAGTGCTGGAGGACCTGCGCAATGTGACCCCCCCTAAGGTGTCCCTGTTTGA GCCCTCTAAGGCCGAGATCGCCAACAAGCAGAAGGCCACCCTGGTGTGCCTGGCCAGAGGCT TCTTCCCTGATCACGTGGAGCTGAGCTGGTGGGTGAATGGCAAGGAGGTGCACTCCGGCGTG TGCACCGACCCACAGGCCTACAAGGAGTCCAACTACTCTTATTGTCTGTCCTCTAGGCTGCG CGTGAGCGCCACATTCTGGCACAACCCTCGGAATCACTTCAGATGCCAGGTGCAGTTTCACG GCCTGAGCGAGGAGGATAAGTGGCCAGAGGGCTCCCCAAAGCCCGTGACCCAGAATATCTCT GCCGAGGCATGGGGCAGGGCCGACTGTGGAATCACCTCCGCCTCTTATCAGCAGGGCGTGCT GTCCGCCACAATCCTGTACGAGATCCTGCTGGGCAAGGCCACCCTGTATGCCGTGCTGGTGT CCACACTGGTGGTCATGGCCATGGTGAAGCGCAAGAACAGCtaa | TCR 57 Beta Codon-Optimized with Codon Optimized Mouse Constant (nt) |
| 56 | GAVVSQHPSWVICKSGTSVKIECRSLDFQATTMFWYRQFPKQSLMLMATSNEGSKATYEQGV EKDKFLINHASLTLSTLTVTSAHPEDSSFYICSARSWRGGLEQFFGPGTRLTVLEDLNKVFP PEVAVFEPSEAEISHTQKATLVCLATGFFPDHVELSWWVNGKEVHSGVCTDPQPLKEQPALN DSRYCLSSRLRVSATFWQNPRNHFRCQVQFYGLSENDEWTQDRAKPVTQIVSAEAWGRADCG FTSVSYQQGVLSATILYEILLGKATLYAVLVSALVLMAMVKRKDF | TCR 57 Beta with Codon Optimized Human Constant (aa) |
| 57 | GAVVSQHPSWVICKSGTSVKIECRSLDFQATTMFWYRQFPKQSLMLMATSNEGSKATYEQGV EKDKFLINHASLTLSTLTVTSAHPEDSSFYICSARSWRGGLEQFFGPGTRLTVLEDLRNVTP PKVSLFEPSKAEIANKQKATLVCLARGFFPDHVELSWWVNGKEVHSGVCTDPQAYKESNYSY CLSSRLRVSATFWHNPRNHFRCQVQFHGLSEEDKWPEGSPKPVTQNISAEAWGRADCGITSA SYQQGVLSATILYEILLGKATLYAVLVSTLVVMAMVKRKNS | TCR 57 Beta with Codon Optimized Mouse Constant (aa) |
| 58 | MLLLLLLLGPGSGLGAVVSQHPSWVICKSGTSVKIECRSLDFQATTMFWYRQFPKQSLMLMA TSNEGSKATYEQGVEKDKFLINHASLTLSTLTVTSAHPEDSSFYICSARSWRGGLEQFFGPG TRLTVLEDLNKVFPPEVAVFEPSEAEISHTQKATLVCLATGFFPDHVELSWWVNGKEVHSGV CTDPQPLKEQPALNDSRYCLSSRLRVSATFWQNPRNHFRCQVQFYGLSENDEWTQDRAKPVT QIVSAEAWGRADCGFTSVSYQQGVLSATILYEILLGKATLYAVLVSALVLMAMVKRKDF | TCR 57 Beta with Codon Optimized Human Constant and signal peptide (aa) |
| 59 | MLLLLLLLGPGSGLGAVVSQHPSWVICKSGTSVKIECRSLDFQATTMFWYRQFPKQSLMLMA TSNEGSKATYEQGVEKDKFLINHASLTLSTLTVTSAHPEDSSFYICSARSWRGGLEQFFGPG TRLTVLEDLRNVTPPKVSLFEPSKAEIANKQKATLVCLARGFFPDHVELSWWVNGKEVHSGV CTDPQAYKESNYSYCLSSRLRVSATFWHNPRNHFRCQVQFHGLSEEDKWPEGSPKPVTQNIS AEAWGRADCGITSASYQQGVLSATILYEILLGKATLYAVLVSTLVVMAMVKRKNS | TCR 57 Beta with Codon Optimized Mouse Constant and signal peptide (aa) |
| 60 | GAVVSQHPSWVICKSGTSVKIECRSLDFQATTMFWYRQFPKQSLMLMATSNEGSKATYEQGV EKDKFLINHASLTLSTLTVTSAHPEDSSFYICSARSWRGGLEQFFGPGTRLTVL | TCR 57 Beta variable region (aa) |
| 61 | DFQATT | TCR 57 Beta CDR1 (aa) |
| 62 | SNEGSKA | TCR 57 Beta CDR2 (aa) |

SEQUENCE TABLE

| SEQ ID NO | SEQUENCE | Description |
|---|---|---|
| 63 | SARSWRGGLEQF | TCR 57 Beta CDR3 (aa) |
| 64 | MLLLLLLLGPGSGL | TCR 57 Beta signal peptide (aa) |
| 65 | ATGCTGCTGCTTCTGCTGCTTCTGGGGCCAGGCTCCGGGCTTGGTGCTGTCGTCTCTCAACA TCCGAGCTGGGTTATCTGTAAGAGTGGAACCTCTGTGAAGATCGAGTGCCGTTCCCTGGACT TTCAGGCCACAACTATGTTTTGGTATCGTCAGTTCCCGAAACAGAGTCTCATGCTGATGGCA ACTTCCAATGAGGGCTCCAAGGCCACATACGAGCAAGGCGTCGAGAAGGACAAGTTTCTCAT CAACCATGCAAGCCTGACCTTGTCCACTCTGACAGTGACCAGTGCCCATCCTGAAGACAGCA GCTTCTACATCTGCAGTGCTAGATCTTGGCGGGGGGGCCTTGAGCAGTTCTTCGGGCCAGGG ACACGGCTCACCGTGCTAgaggacctgaataaggtgttcccccctgaggtggccgtgtttga gccaagcgaggccgagatctcccacacccagaaggccaccctggtgtgcctggcaaccggct tctttcccgatcacgtggagctgtcctggtgggtgaacggcaaggaggtgcactctggcgtg tgcacagacccacagccccctgaaggagcagcctgccctgaatgattcccgctattgtctgtc ctctcggctgagagtgtctgccacctttggcagaacccacggaatcacttcagatgccagg tgcagttttacggcctgtctgagaacgacgagtggacccaggatcgggccaagcctgtgaca cagatcgtgagcgcggaagcatggggcagagccgactgtggcttcaccagcgtgtcctatca gcagggcgtgctgtccgccaccatcctgtacgagatcctgctgggcaaggccacactgtatg ccgtgctggtgtctgccctggtgctgatggccatggtgaagagaaaagacttctaaggctcc ggagcaaccaatttcagcctgctgaagcaggccggcgatgtggaggagaatcctggcccaAT GGTCCTGAAATTCTCCGTGTCCATTCTTTGGATTCAGTTGGCATGGGTGAGCACCCAGCTGC TGGAGCAGAGCCCTCAGTTTCTAAGCATCCAAGAGGGAGAAAATCTCACTGTGTACTGCAAC TCCTCAAGTGTTTTTTCCAGCTTACAATGGTACAGACAGGAGCCTGGGGAAGGTCCTGTCCT CCTGGTGACAGTAGTTACGGGTGGAGAAGTGAAGAAGCTGAAGAGACTAACCTTTCAGTTTG GTGATGCAAGAAAGGACAGTTCTCTCCACATCACTGCaGCCCAGCCTGGTGATACAGGCCTC TACCTCTGTGCAGGAGCTCGCAACTTCAACAAATTTTACTTTGGATCTGGGACCAAACTCAA TGTAAAACCAAATATCCAGAATCCGGACCccgcggtatatcaactgcgcgactcaaaatcat ccgataagagtgtctgtttgtttactgacttcgacagtcaaactaatgtctctcagagcaaa gattccgatgtctacatcactgacaagtgcgttctggatatgcggagcatggattttaagtc caactccgccgtagcctggtccaacaagtcagactttgcctgtgcaaatgctttcaacaact caattatccctgaggacactttctttccttcaccggagtcctcatgcgatgttaaactggtc gaaaaatcttttgagacggatacgaacctcaacttccaaaatttgagcgttattggctttag gattctgcttctcaaggttgcggggttcaatctcctgatgacgttgcggctttggagcagct aa | TCR 57 Native full sequence with human constant (nt) |
| 66 | ATGCTGCTGCTTCTGCTGCTTCTGGGGCCAGGCTCCGGGCTTGGTGCTGTCGTCTCTCAACA TCCGAGCTGGGTTATCTGTAAGAGTGGAACCTCTGTGAAGATCGAGTGCCGTTCCCTGGACT TTCAGGCCACAACTATGTTTTGGTATCGTCAGTTCCCGAAACAGAGTCTCATGCTGATGGCA ACTTCCAATGAGGGCTCCAAGGCCACATACGAGCAAGGCGTCGAGAAGGACAAGTTTCTCAT CAACCATGCAAGCCTGACCTTGTCCACTCTGACAGTGACCAGTGCCCATCCTGAAGACAGCA GCTTCTACATCTGCAGTGCTAGATCTTGGCGGGGGGGCCTTGAGCAGTTCTTCGGGCCAGGG ACACGGCTCACCGTGCTAGAGGACCTGCGCAATGTGACCCCCCCTAAGGTGTCCCTGTTTGA GCCCTCTAAGGCCGAGATCGCCAACAAGCAGAAGGCCACCCTGGTGTGCCTGGCCAGAGGCT TCTTCCCTGATCACGTGGAGCTGAGCTGGTGGGTGAATGGCAAGGAGGTGCACTCCGGCGTG TGCACCGACCCACAGGCCTACAAGGAGTCCAACTACTCTTATTGTCTGTCCTCTAGGCTGCG CGTGAGCGCCACATTCTGGCACAACCCTCGGAATCACTTCAGATGCCAGGTGCAGTTTCACG GCCTGAGCGAGGAGGATAAGTGGCCAGAGGGCTCCCCAAAGCCCGTGACCCAGAATATCTCT GCCGAGGCATGGGGCAGGCCGACTGTGGAATCACCTCCGCCTCTTATCAGCAGGGCGTGCT GTCCGCCACAATCCTGTACGAGATCCTGCTGGGCAAGGCCACCCTGTATGCCGTGCTGGTGT CCACACTGGTGGTCATGGCCATGGTGAAGCGCAACAACAGCtaaggctccggagcaaccaat ttcagcctgctgaagcaggccggcgatgtggaggagaatcctggcccaATGGTCCTGAAATT CTCCGTGTCCATTCTTTGGATTCAGTTGGCATGGGTGAGCACCCAGCTGCTGGAGCAGAGCC CTCAGTTTCTAAGCATCCAAGAGGGAGAAAATCTCACTGTGTACTGCAACTCCTCAAGTGTT TTTTCCAGCTTACAATGGTACAGACAGGAGCCTGGGGAAGGTCCTGTCCTCCTGGTGACAGT AGTTACGGGTGGAGAAGTGAAGAAGCTGAAGAGACTAACCTTTCAGTTTGGTGATGCAAGAA AGGACAGTTCTCTCCACATCACTGCaGCCCAGCCTGGTGATACAGGCCTCTACCTCTGTGCA GGAGCTCGCAACTTCAACAAATTTTACTTTGGATCTGGGACCAAACTCAATGTAAAACCAAA TATCCAGAATCCGGAGCCTGCCGTGTACCAGCTGAAGGACCCACGGAGCCAGGATAGCACCC TGTGCCTGTTCACCGACTTTGATTCTCAGATCAACGTGCCCAAGACCATGGAGAGCGGCACC TTCATCACAGACAAGTGCGTGCTGGATATGAAGGCCATGGACAGCAAGTCCAACGGCGCCAT CGCCTGGTCCAATCAGACATCTTTCACCTGCCAGGATATCTTTAAGGAGACAAATGCCACCT ATCCTTCCTCTGACGTGCCATGTGATGCCACCCTGACAGAGAAGAGCTTCGAGACCGACATG AACCTGAATTTTCAGAATCTGCTCGTGATTGTCCTGAGAATCCTGCTGCTGAAGGTGGCCGG CTTTAACCTGCTGATGACCCTGAGGCTGTGGAGCTCCTGA | TCR 57 Native full sequence with mouse constant (nt) |
| 67 | ATGCTCCTGCTGCTTCTGCTCCTCGGGCCCGGCAGCGGTCTCGGCGCCGTCGTGTCGCAGCA CCCGTCGTGGGTGATTTGCAAGAGCGGAACGAGCGTGAAGATCGAGTGCCGCTCGCTCGACT TCCAGGCCACAACCATGTTCTGGTACCGCCAGTTTCCCAAGCAGAGCCTCATGCTGATGGCC ACAAGCAATGAAGGCAGCAAGGCCACTTATGAACAGGGCGTGGAGAAGGACAAGTTTCTGAT CAACCACGCCTCCCTGACCCTGTCCACCCTCACTGTGACCAGCGCCCACCCTGAGGACAGCA | TCR 57 Codon-optimized full sequence with human constant (nt) |

SEQUENCE TABLE

| SEQ ID NO | SEQUENCE | Description |
|---|---|---|
| | GCTTCTACATCTGCAGCGCCCGCAGCTGGAGGGGCGGCCTGGAGCAGTTCTTCGGCCCTGGC<br>ACCCGGCTGACAGTGCTGgaggacctgaataaggtgttccccctgaggtggccgtgtttga<br>gccaagcgaggccgagatctcccacacccagaaggccaccctggtgtgcctggcaaccggct<br>tctttcccgatcacgtggagctgtcctggtgggtgaacggcaaggaggtgcactctggcgtg<br>tgcacagaccacagcccctgaaggagcagcctgccctgaatgattcccgctattgtctgtc<br>ctctcggctgagagtgtctgccacctttggcagaacccacggaatcacttcagatgccagg<br>tgcagttttacggcctgtctgagaacgacgagtggaccaggatcgggccaagcctgtgaca<br>cagatcgtgagcgcggaagcatggggcagagccgactgtggcttcaccagcgtgtcctatca<br>gcagggcgtgctgtccgccaccatcctgtacgagatcctgctgggcaaggccacactgtatg<br>ccgtgctggtgtctgccctggtgctgatggccatggtgaagagaaaagacttctaaggctcc<br>ggagcaaccaatttcagcgctgaagcaggccggcgatgtggaggagaatcctggcccaAT<br>GGTGCTGAAGTTTTCTGTGAGCATCCTGTGGATTCAGCTGGCCTGGGTGTCCACCCAGCTCC<br>TGGAGCAGAGCCCCCAGTTCCTGTCCATCCAGGAGGGCGAGAACCTGACCGTGTACTGCAAC<br>AGCTCTTCTGTCTTTTCATCACTGCAGTGGTATAGACAAGAACCGGGTGAAGGTCCAGTTCT<br>GCTGGTGACCGTCGTCACCGGCGGCGAGGTGAAGAAGCTAAAGCGCCTGACGTTCCAGTTCG<br>GAGACGCGCGGAAGGACTCGTCGCTGCACATCACCGCCGCCCAGCCCGGCGACACCGGCCTG<br>TACCTGTGCGCTGGCGCGCGCAACTTCAACAAGTTCTACTTCGGCAGCGGCACCAAGCTGAA<br>CGTGAAACCGAATATCCAGAATCCGGACCCcgcggtatatcaactgcgcgactcaaaatcat<br>ccgataagagtgtctgtttgtttactgacttcgacagtcaaactaatgtctctcagagcaaa<br>gattccgatgtctacatcactgacaagtgcgttctggatatgcggagcatggattttaagtc<br>caactccgccgtagcctggtccaacaagtcagactttgcctgtgcaaatgctttcaacaact<br>caattatccctgaggacactttcttccttcaccggagtcctcatgcgatgttaaactggtc<br>gaaaaatcttttgagacggatacgaacctcaacttccaaaatttgagcgttattggctttag<br>gattctgcttctcaaggttgcggggttcaatctcctgatgacgttgcggctttggagcagct<br>aa | |
| 68 | ATGCTCCTGCTGCTTCTGCTCCTCGGGCCCGGCAGCGGTCTCGGCGCCGTCGTGTCGCAGCA<br>CCCGTCGTGGGTGATTTGCAAGAGCGGAACGAGCGTGAAGATCGAGTGCCGCTCGCTCGACT<br>TCCAGGCTCACAACCATGTTCTGGTACCGCCAGTTTCCCAAGCAGAGCCTCATGCTGATGGCC<br>ACAAGCAATGAAGGCAGCAAGGCCACTTATGAACAGGGCGTGGAGAAGGACAAGTTTCTGAT<br>CAACCACGCCTCCCTGACCCTGTCCACCCTCACTGTGACCAGCGCCCACCCTGAGGACAGCA<br>GCTTCTACATCTGCAGCGCCCGCAGCTGGAGGGGCGGCCTGGAGCAGTTCTTCGGCCCTGGC<br>ACCCGGCTGACAGTGCTGGAGGACCTGCGCAATGTGACCCCCCCTAAGGTGTCCCTGTTTGA<br>GCCCTCTAAGGCCGAGATCGCCAACAAGCAGAAGGCCACCCTGGTGTGCCTGGCCAGAGGCT<br>TCTTCCCTGATCACGTGGAGCTGAGCTGGTGGGTGAATGGCAAGGAGGTGCACTCCGGCGTG<br>TGCACCGACCCACAGGCCTACAAGGAGTCCAACTACTCTTATTGTCTGTCCTCTAGGCTGCG<br>CGTGAGCGCCACATTCTGGCACAACCCTCGGAATCACTTCAGATGCCAGGTGCAGTTTCACG<br>GCCTGAGCGAGGAGGATAAGTGGCCAGAGGGCTCCCCAAAGCCCGTGACCCAGAATATCTCT<br>GCCGAGGCATGGGGCAGGGCCGACTGTGGAATCACCTCCGCCTCTTATCAGCAGGGCGTGCT<br>GTCCGCCACAATCCTGTACGAGATCCTGCTGGGCAAGGCCACCCTGTATGCCGTGCTGGTGT<br>CCACACTGGTGGTCATGGCCATGGTGAAGCGCAAGAACAGCtaaggctccggagcaaccaat<br>ttcagcctgctgaagcaggccggcgatgtggaggagaatcctggcccaATGGTGCTGAAGTT<br>TTCTGTGAGCATCCTGTGGATTCAGCTGGCCTGGGTGTCCACCCAGCTCCTGGAGCAGAGCC<br>CCCAGTTCCTGTCCATCCAGGAGGGCGAGAACCTGACCGTGTACTGCAACAGCTCTTCTGTC<br>TTTTCATCACTGCAGTGGTATAGACAAGAACCGGGTGAAGGTTCCAGTTCTGCTGGTGACCGT<br>CGTCACCGGCGGCGAGGTGAAGAAGCTAAAGCGCCTGACGTTCCAGTTCGGAGACGCGCGGA<br>AGGACTCGTCGCTGCACATCACCGCCGCCCAGCCCGGCGACACCGGCCTGTACCTGTGCGCT<br>GGCGCGCGCAACTTCAACAAGTTCTACTTCGGCAGCGGCACCAAGCTGAACGTGAAACCGAA<br>TATCCAGAATCCGGAGCCTGCCGTGTACCAGCTGAAGGACCCCAGGAGCAGGATAGCACCC<br>TGTGCCTGTTCACCGACTTTGATTCTCAGATCAACGTGCCCAAGACCATGGAGAGCGGCACC<br>TTCATCACAGACAAGTGCGTGCTGGATATGAAGGCCATGGACAGCAAGTCCAACGGCGCCAT<br>CGCCTGGTCCAATCAGACATCTTTCACCTGCCAGGATATCTTTAAGGAGACAAATGCCACCT<br>ATCCTTCCTCTGACGTGCCATGTGATGCCACCCTGACAGAGAAGAGCTTCGAGACCGACATG<br>AACCTGAATTTTCAGAATCTGCTCGTGATTGTCCTGAGAATCCTGCTGCTGAAGGTGGCCGG<br>CTTTAACCTGCTGATGACCCTGAGGCTGTGGAGCTCCTGA | TCR 57 Codon-optimized full sequence with mouse constant (nt) |
| 69 | MLLLLLLLGPGSGLGAVVSQHPSWVICKSGTSVKIECRSLDFQATTMFWYRQFPKQSLMLMA<br>TSNEGSKATYEQGVEKDKFLINHASLTLSTLTVTSAHPEDSSFYICSARSWRGGLEQFFGPG<br>TRLTVLEDLNKVFPPEVAVFEPSEAEISHTQKATLVCLATGFFPDHVELSWWVNGKEVHSGV<br>CTDPQPLKEQPALNDSRYCLSSRLRVSATFWQNPRNHFRCQVQFYGLSENDEWTQDRAKPVT<br>QIVSAEAWGRADCGFTSVSYQQGVLSATILYEILLGKATLYAVLVSALVLMAMVKRKDFGSG<br>ATNFSLLKQAGDVEENPGPMVLKFSVSILWIQLAWVSTQLLEQSPQFLSIQEGENLTVYCNS<br>SSVFSSLQWYRQEPGEGPVLLVTVVTGGEVKKLKRLTFQFGDARKDSSLHITAAQPGDTGLY<br>LCAGARNFNKFYFGSGTKLNVKPNIQNPDPAVYQLRDSKSSDKSVCLFTDFDSQTNVSQSKD<br>SDVYITDKCVLDMRSMDFKSNSAVAWSNKSDFACANAFNNSIIPEDTFFPSPESSCDVKLVE<br>KSFETDTNLNFQNLSVIGFRILLLKVAGFNLLMTLRLWSS | TCR 57 Full sequence with human constant (aa) |
| 70 | MLLLLLLLGPGSGLGAVVSQHPSWVICKSGTSVKIECRSLDFQATTMFWYRQFPKQSLMLMA<br>TSNEGSKATYEQGVEKDKFLINHASLTLSTLTVTSAHPEDSSFYICSARSWRGGLEQFFGPG<br>TRLTVLEDLRNVTPPKVSLFEPSKAEIANKQKATLVCLARGFFPDHVELSWWVNGKEVHSGV<br>CTDPQAYKESNYSYCLSSRLRVSATFWHNPRNHFRCQVQFHGLSEEDKWPEGSPKPVTQNIS<br>AEAWGRADCGITSASYQQGVLSATILYEILLGKATLYAVLVSTLVVMAMVKRKNSGSGATNF<br>SLLKQAGDVEENPGPMVLKFSVSILWIQLAWVSTQLLEQSPQFLSIQEGENLTVYCNSSSVF | TCR 57 Full sequence with mouse constant (aa) |

| SEQ ID NO | SEQUENCE | Description |
|---|---|---|
|  | SSLQWYRQEPGEGPVLLVTVVTGGEVKKLKRLTFQFGDARKDSSLHITAAQPGDTGLYLCAG ARNFNKFYFGSGTKLNVKPNIQNPEPAVYQLKDPRSQDSTLCLFTDFDSQINVPKTMESGTF ITDKCVLDMKAMDSKSNGAIAWSNQTSFTCQDIFKETNATYPSSDVPCDATLTEKSFETDMN LNFQNLLVIVLRILLLKVAGFNLLMTLRLWSS |  |
| 71 | ATGATGATATCCTTGAGAGTTTTACTGGTGATCCTGTGGCTTCAGTTAAGCTGGGTTTGGAG CCAACGGAAGGAGGTGGAGCAGGATCCTGGACCCTTCAATGTTCCAGAGGGAGCCACTGTCG CTTTCAACTGTACTTACAGCAACAGTGCTTCTCAGTCTTTCTTCTGGTACAGACAGGATTGC AGGAAAGAACCTAAGTTGCTGATGTCcGTATACTCCAGTGGTAATGAAGATGGAAGGTTTAC AGCACAGCTCAATAGAGCCAGCCAGTATATTTCCCTGCTCATCAGAGACTCCAAGCTCAGTG ATTCAGCCACCTACCTCTGTGTGGTGAACAGGGATAACTATGGTCAGAATTTTGTCTTTGGT CCCGGAACCAGATTGTCCGTGCTGCCCAATATCCAGAATCCGGACCCcgcggtatatcaact gcgcgacttcaaaatcatccgataagagtgtctgtttgtttactgacttcgacagtcaaacta atgtctctcagagcaaagattccgatgtctacatcactgacaagtgcgttctggatatgcgg agcatggattttaagtccaactccgccgtagcctggtccaacaagtcagactttgcctgtgc aaatgctttcaacaactcaattatccctgaggacactttctttcctcaccggagtcctcat gcgatgttaaactggtcgaaaaatcttttgagacggatacgaacctcaacttccaaaatttg agcgttattggctttaggattctgcttctcaaggttgcggggttcaatctcctgatgacgtt gcggctttggagcagctaa | TCR 58 Alpha Native with Codon Optimized Human Constant (nt) |
| 72 | ATGATGATATCCTTGAGAGTTTTACTGGTGATCCTGTGGCTTCAGTTAAGCTGGGTTTGGAG CCAACGGAAGGAGGTGGAGCAGGATCCTGGACCCTTCAATGTTCCAGAGGGAGCCACTGTCG CTTTCAACTGTACTTACAGCAACAGTGCTTCTCAGTCTTTCTTCTGGTACAGACAGGATTGC AGGAAAGAACCTAAGTTGCTGATGTCcGTATACTCCAGTGGTAATGAAGATGGAAGGTTTAC AGCACAGCTCAATAGAGCCAGCCAGTATATTTCCCTGCTCATCAGAGACTCCAAGCTCAGTG ATTCAGCCACCTACCTCTGTGTGGTGAACAGGGATAACTATGGTCAGAATTTTGTCTTTGGT CCCGGAACCAGATTGTCCGTGCTGCCCAATATCCAGAATCCGGAGCCTGCCGTGTACCAGCT GAAGGACCCACGGAGCCAGGATAGCACCCTGTGCCTGTTCACCGACTTTGATTCTCAGATCA ACGTGCCCAAGACCATGGAGAGCGGCACCTTCATCACAGACAAGTGCGTGCTGGATATGAAG GCCATGGACAGCAAGTCCAACGGCGCCATCGCCTGGTCCAATCAGACATCTTTCACCTGCCA GGATATCTTTAAGGAGACAAATGCCACCTATCCTTCCTCTGACGTGCCCATGTGATGCCACCC TGACAGAAGAGCTTCGAGACCGACATGAACCTGAATTTTCAGAATCTGCTCGTGATTGTC CTGAGAATCCTGCTGCTGAAGGTGGCCGGCTTTAACCTGCTGATGACCCTGAGGCTGTGGAG CTCCTGA | TCR 58 Alpha Native with Codon Optimized Mouse Constant (nt) |
| 73 | RKEVEQDPGPFNVPEGATVAFNCTYSNSASQSFFWYRQDCRKEPKLLMSVYSSGNEDGRFTA QLNRASQYISLLIRDSKLSDSATYLCVVNRDNYGQNFVFGPGTRLSVLPNIQNPDPAVYQLR DSKSSDKSVCLFTDFDSQTNVSQSKDSDVYITDKCVLDMRSMDFKSNSAVAWSNKSDFACAN AFNNSIIPEDTFFPSPESSCDVKLVEKSFETDTNLNFQNLSVIGFRILLLKVAGFNLLMTLR LWSS | TCR 58 Alpha with Codon Optimized Human Constant (aa) |
| 74 | RKEVEQDPGPFNVPEGATVAFNCTYSNSASQSFFWYRQDCRKEPKLLMSVYSSGNEDGRFTA QLNRASQYISLLIRDSKLSDSATYLCVVNRDNYGQNFVFGPGTRLSVLPNIQNPEPAVYQLK DPRSQDSTLCLFTDFDSQINVPKTMESGTFITDKCVLDMKAMDSKSNGAIAWSNQTSFTCQD IFKETNATYPSSDVPCDATLTEKSFETDMNLNFQNLLVIVLRILLLKVAGFNLLMTLRLWSS | TCR 58 Alpha with Codon Optimized Mouse Constant (aa) |
| 75 | MMISLRVLLVILWLQLSWVWSQRKEVEQDPGPFNVPEGATVAFNCTYSNSASQSFFWYRQDC RKEPKLLMSVYSSGNEDGRFTAQLNRASQYISLLIRDSKLSDSATYLCVVNRDNYGQNFVFG PGTRLSVLPNIQNPDPAVYQLRDSKSSDKSVCLFTDFDSQTNVSQSKDSDVYITDKCVLDMR SMDFKSNSAVAWSNKSDFACANAFNNSIIPEDTFFPSPESSCDVKLVEKSFETDTNLNFQNL SVIGFRILLLKVAGFNLLMTLRLWSS | TCR 58 Alpha with Codon Optimized Human Constant and signal peptide (aa) |
| 76 | MMISLRVLLVILWLQLSWVWSQRKEVEQDPGPFNVPEGATVAFNCTYSNSASQSFFWYRQDC RKEPKLLMSVYSSGNEDGRFTAQLNRASQYISLLIRDSKLSDSATYLCVVNRDNYGQNFVFG PGTRLSVLPNIQNPEPAVYQLKDPRSQDSTLCLFTDFDSQINVPKTMESGTFITDKCVLDMK AMDSKSNGAIAWSNQTSFTCQDIFKETNATYPSSDVPCDATLTEKSFETDMNLNFQNLLVIV LRILLLKVAGFNLLMTLRLWSS | TCR 58 Alpha with Codon Optimized Mouse Constant and signal peptide (aa) |
| 77 | RKEVEQDPGPFNVPEGATVAFNCTYSNSASQSFFWYRQDCRKEPKLLMSVYSSGNEDGRFTA QLNRASQYISLLIRDSKLSDSATYLCVVNRDNYGQNFVFGPGTRLSVLP | TCR 58 Alpha variable region (aa) |
| 78 | NSASQS | TCR 58 Alpha CDR1 (aa) |
| 79 | VYSSGN | TCR 58 Alpha CDR2 (aa) |

SEQUENCE TABLE

| SEQ ID NO | SEQUENCE | Description |
|---|---|---|
| 80 | VVNRDNYGQNFV | TCR 58 Alpha CDR3 (aa) |
| 81 | MMISLRVLLVILWLQLSWVWSQ | TCR 58 Alpha Signal peptide (aa) |
| 82 | ATGGATACCTGGCTCGTATGCTGGGCAATTTTTAGTCTCTTGAAAGCAGGACTCACAGAACC<br>TGAAGTCACCCAGACTCCCAGCCATCAGGTCACACAGATGGGACAGGAAGTGATCTTGCGCT<br>GTGTCCCCATCTCTAATCACTTATACTTCTATTGGTACAGACAAATCTTGGGGCAGAAAGTC<br>GAGTTTCTGGTTTCCTTTTATAATAATGAAATCTCAGAGAGTCTGAAATATTCGATGATCA<br>ATTCTCAGTTGAAAGGCCTGATGGATCAAATTTCACTCTGAAGATCCGGTCCACAAAGCTGG<br>AGGACTCAGCCATGTACTTCTGTGCCAGCACCCCCGAAGCTCCTACGAGCAGTACTTCGGG<br>CCGGGCACCAGGCTCACGGTCACAgaggacctgaataaggtgttccccctgaggtggccgt<br>gtttgagccaagcgaggccgagatctcccacacccagaaggccaccctggtgtgcctggcaa<br>ccggcttcttcccgatcacgtggagctgtcctggtgggtgaacggcaaggaggtgcactct<br>ggcgtgtgcacagaccccacagcccctgaaggagcagcctgcctgaatgattcccgctattg<br>tctgtcctctcggctgagagtgtctgccaccttttggcagaacccacggaatcacttcagat<br>gccaggtgcagttttacggcctgtctgagaacgacgagtggaccaggatcgggccaagcct<br>gtgacacagatcgtgagcgcggaagcatggggcagagccgactgtggcttcaccagcgtgtc<br>ctatcagcagggcgtgctgtccgccaccatcctgtacgagatcctgctgggcaaggccacac<br>tgtatgccgtgctggtgtctgccctggtgctgatggccatggtgaagagaaaagacttctaa | TCR 58 Beta Native with Codon Optimized Human Constant (nt) |
| 83 | ATGGATACCTGGCTCGTATGCTGGGCAATTTTTAGTCTCTTGAAAGCAGGACTCACAGAACC<br>TGAAGTCACCCAGACTCCCAGCCATCAGGTCACACAGATGGGACAGGAAGTGATCTTGCGCT<br>GTGTCCCCATCTCTAATCACTTATACTTCTATTGGTACAGACAAATCTTGGGGCAGAAAGTC<br>GAGTTTCTGGTTTCCTTTTATAATAATGAAATCTCAGAGAGTCTGAAATATTCGATGATCA<br>ATTCTCAGTTGAAAGGCCTGATGGATCAAATTTCACTCTGAAGATCCGGTCCACAAAGCTGG<br>AGGACTCAGCCATGTACTTCTGTGCCAGCACCCCCGAAGCTCCTACGAGCAGTACTTCGGG<br>CCGGGCACCAGGCTCACGGTCACAGAGGACCTGCGCAATGTGACCCCCCTAAGGTGTCCCT<br>GTTTGAGCCCTCAAGGCCGAGATCGCCAACAAGCAGAAGGCCACCCTGGTGTGCCTGGCCA<br>GAGGCTTCTTCCCTGATCACGTGGAGCTGAGCTGGTGGGTGAATGGCAAGGAGGTGCACTCC<br>GGCGTGTGCACCGACCCACAGGCCTACAAGGAGTCCAACTACTCTTATTGTCTGTCCTCTAG<br>GCTGCGCGTGAGCGCCACATTCTGGCACAACCCTCGGAATCACTTCAGATGCCAGGTGCAGT<br>TCACGGCCTGAGCGAGGAGGATAAGTGGCCAGAGGGCTCCCCAAAGCCCGTGACCCAGAAT<br>ATCTCTGCCGAGGCATGGGGCAGGGCCGACTGTGGAATCACCTCCGCCTCTTATCAGCAGGG<br>CGTGCTGTCCGCCACAATCCTGTACGAGATCCTGCTGGGCAAGGCCACCCTGTATGCCGTGC<br>TGGTGTCCACACTGGTGGTCATGGCCATGGTGAAGCGCAAGAACAGCtaa | TCR 58 Beta Native with Codon Optimized Mouse Constant (nt) |
| 84 | EPEVTQTPSHQVTQMGQEVILRCVPISNHLYFYWYRQILGQKVEFLVSFYNNEISEKSEIFD<br>DQFSVERPDGSNFTLKIRSTKLEDSAMYFCASTPRSSYEQYFGPGTRLTVTEDLNKVFPPEV<br>AVFEPSEAEISHTQKATLVCLATGFFPDHVELSWWVNGKEVHSGVCTDPQPLKEQPALNDSR<br>YCLSSRLRVSATFWQNPRNHFRCQVQFYGLSENDEWTQDRAKPVTQIVSAEAWGRADCGFTS<br>VSYQQGVLSATILYEILLGKATLYAVLVSALVLMAMVKRKDF | TCR 58 Beta with Codon Optimized Human Constant (aa) |
| 85 | EPEVTQTPSHQVTQMGQEVILRCVPISNHLYFYWYRQILGQKVEFLVSFYNNEISEKSEIFD<br>DQFSVERPDGSNFTLKIRSTKLEDSAMYFCASTPRSSYEQYFGPGTRLTVTEDLRNVTPPKV<br>SLFEPSKAEIANKQKATLVCLARGFFPDHVELSWWVNGKEVHSGVCTDPQAYKESNYSYCLS<br>SRLRVSATFWHNPRNHFRCQVFHGLSEEDKWPEGSPKPVTQNISAEAWGRADCGITSASYQ<br>QGVLSATILYEILLGKATLYAVLVSTLVVMAMVKRKNS | TCR 58 Beta with Codon Optimized Mouse Constant (aa) |
| 86 | MDTWLVCWAIFSLLKAGLTEPEVTQTPSHQVTQMGQEVILRCVPISNHLYFYWYRQILGQKV<br>EFLVSFYNNEISEKSEIFDDQFSVERPDGSNFTLKIRSTKLEDSAMYFCASTPRSSYEQYFG<br>PGTRLTVTEDLNKVFPPEVAVFEPSEAEISHTQKATLVCLATGFFPDHVELSWWVNGKEVHS<br>GVCTDPQPLKEQPALNDSRYCLSSRLRVSATFWQNPRNHFRCQVQFYGLSENDEWTQDRAKP<br>VTQIVSAEAWGRADCGFTSVSYQQGVLSATILYEILLGKATLYAVLVSALVLMAMVKRKDF | TCR 58 Beta with Codon Optimized Human Constant and signal peptide (aa) |
| 87 | MDTWLVCWAIFSLLKAGLTEPEVTQTPSHQVTQMGQEVILRCVPISNHLYFYWYRQILGQKV<br>EFLVSFYNNEISEKSEIFDDQFSVERPDGSNFTLKIRSTKLEDSAMYFCASTPRSSYEQYFG<br>PGTRLTVTEDLRNVTPPKVSLFEPSKAEIANKQKATLVCLARGFFPDHVELSWWVNGKEVHS<br>GVCTDPQAYKESNYSYCLSSRLRVSATFWHNPRNHFRCQVQFHGLSEEDKWPEGSPKPVTQN<br>ISAEAWGRADCGITSASYQQGVLSATILYEILLGKATLYAVLVSTLVVMAMVKRKNS | TCR 58 Beta with Codon Optimized Mouse Constant and signal peptide (aa) |
| 88 | EPEVTQTPSHQVTQMGQEVILRCVPISNHLYFYWYRQILGQKVEFLVSFYNNEISEKSEIFD<br>DQFSVERPDGSNFTLKIRSTKLEDSAMYFCASTPRSSYEQYFGPGTRLTVT | TCR 58 Beta variable region (aa) |

| SEQ ID NO | SEQUENCE | Description |
|---|---|---|
| 89 | SNHLY | TCR 58, 59, 60, 61 Beta CDR1 (aa) |
| 90 | FYNNEI | TCR 58, 59, 60 61 Beta CDR2 (aa) |
| 91 | ASTPRSSYEQY | TCR 58 Beta CDR3 (aa) |
| 92 | MDTWLVCWAIFSLLKAGLT | TCR 58, 59, 60, 61 Beta signal peptide (aa) |
| 93 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCAGCACCCCCCGAAGCTCCTACGAGCAGTACTTCGGG CCGGGCACCAGGCTCACGGTCACAgaggacctgaataaggtgttccccctgaggtggccgt gtttgagccaagcgaggccgagatctcccacacccagaaggccaccctggtgtgcctggcaa ccggcttcttttcccgatcacgtggagctgtcctggtgggtgaacggcaaggaggtgcactct ggcgtgtgcacagacccacagccctgaaggagcagcctgccctgaatgattcccgctattg tctgtcctctcggctgagagtgtctgccaccttttggcagaacccacggaatcacttcagat gccaggtgcagttttacggcctgtctgagaacgacgagtggaccaggatcgggccaagcct gtgacacagatcgtgagcgcggaagcatggggcagagccgactgtggcttcaccagcgtgtc ctatcagcagggcgtgctgtccgccaccatcctgtacgagatcctgctgggcaaggccacac tgtatgccgtgctggtgtctgccctggtgctgatggccatggtgaagagaaaagacttctaa ggctccggagcaaccaatttcagcctgctgaagcaggccggcgatgtggaggagaatcctgg cccaATGATGATATCCTTGAGAGTTTTACTGGTGATCCTGTGGCTTCAGTTAAGCTGGGTTT GGAGCCAACGGAAGGAGGTGGAGCAGGATCCTGGACCCTTCAATGTTCCAGAGGGAGCCACT GTCGCTTTCAACTGTACTTACAGCAACAGTGCTTCTCAGTCTTTCTTCTGGTACAGACAGGA TTGCAGGAAAGAACCTAAGTTGCTGATGTCcGTATACTCCAGTGGTAATGAAGATGGAAGGT TTACAGCACAGCTCAATAGAGCCAGCCAGTATATTTCCCTGCTCATCAGAGACTCCAAGCTC AGTGATTCAGCCACCTACCTCTGTGTGGTGAACAGGGATAACTATGGTCAGAATTTTGTCTT TGGTCCCGGAACCAGATTGTCCGTGCTGCCCAATATCCAGAATCCGGACCCcgcggtatatc aactgcgcgactcaaaatcatccgataagagtgtctgtttgtttactgacttcgacagtcaa actaatgtctctcagagcaaagattccgatgtctacatcactgacaagtgcgttctggatat gcggagcatggattttaagtccaactccgcgtagcctggtccaacaagtcagactttgcct gtgcaaatgctttcaacaactcaattatccctgaggacactttctttccttcaccggagtcc tcatgcgatgttaaactggtcgaaaaatcttttgagacggatacgaacctcaacttccaaaa tttgagcgttattggctttaggattctgcttctcaaggttgcggggttcaatctcctgatga cgttgcggcttttggagcagctaa | TCR 58 Native full sequence with human constant (nt) |
| 94 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCAGCACCCCCCGAAGCTCCTACGAGCAGTACTTCGGG CCGGGCACCAGGCTCACGGTCACAGAGGACCTGCGCAATGTGACCCCCCTAAGGTGTCCCT GTTTGAGCCCTCAAGGCCGAGATCGCCAACAAGCAGAAGGCCACCCTGGTGTGCCTGGCCA GAGGCTTCTTCCCTGATCACGTGGAGCTGAGCTGGTGGGTGAATGGCAAGGAGGTGCACTCC GGCGTGTGCACCGACCCACAGGCCTACAAGGAGTCCAACTACTCTTATTGTCTGTCCTCTAG GCTGCGCGTGAGCGCCACATTCTGGCACAACCCTCGGAATCACTTCAGATGCCAGGTGCAGT TTCACGGCCTGAGCGAGGAGGATAAGTGGCCAGAGGGCTCCCAAAGCCCGTGACCCAGAAT ATCTCTGCCGAGGCATGGGGCAGGGCCGACTGTGGAATCACCTCCGCCTCTTATCAGCAGGG CGTGCTGTCCGCCACAATCCTGTACGAGATCCTGCTGGGCAAGGCCACCCTGTATGCCGTGC TGGTGTCCACACTGGTGGTCATGGCCATGGTGAAGCGCAAGAACAGCtaaggctccggagca accaatttcagcctgctgaagcaggccggcgatgtggaggagaatcctggcccaATGATGAT ATCCTTGAGAGTTTTACTGGTGATCCTGTGGCTTCAGTTAAGCTGGGTTTGGAGCCAACGGA AGGAGGTGGAGCAGGATCCTGGACCCTTCAATGTTCCAGAGGGAGCCACTGTCGCTTTCAAC TGTACTTACAGCAACAGTGCTTCTCAGTCTTTCTTCTGGTACAGACAGGATTGCAGGAAAGA ACCTAAGTTGCTGATGTCcGTATACTCCAGTGGTAATGAAGATGGAAGGTTTACAGCACAGC TCAATAGAGCCAGCCAGTATATTTCCCTGCTCATCAGAGACTCCAAGCTCAGTGATTCAGCC ACCTACCTCTGTGTGGTGAACAGGGATAACTATGGTCAGAATTTTGTCTTTGGTCCCGGAAC CAGATTGTCCGTGCTGCCCAATATCCAGAATCCGGAGCCTGCCGTGTACCAGCTGAAGGACC CACGGAGCCAGGATAGCACCCTGTGCCTGTTCACCGACTTTGATTCTCAGATCAACGTGCCC AAGACCATGGAGAGCGGCACCTTCATCACAGACAAGTGCGTGCTGGATATGAAGGCCATGGA CAGCAAGTCCAACGGCGCCATCGCCTGGTCCAATCAGACATCTTTCACCTGCCAGGATATCT | TCR 58 Native full sequence with mouse constant (nt) |

| SEQ ID NO | SEQUENCE | Description |
|---|---|---|
| | TTAAGGAGACAAATGCCACCTATCCTTCCTCTGACGTGCCATGTGATGCCACCCTGACAGAG<br>AAGAGCTTCGAGACCGACATGAACCTGAATTTTCAGAATCTGCTCGTGATTGTCCTGAGAAT<br>CCTGCTGCTGAAGGTGGCCGGCTTTAACCTGCTGATGACCCTGAGGCTGTGGAGCTCCTGA | |
| 95 | MDTWLVCWAIFSLLKAGLTEPEVTQTPSHQVTQMGQEVILRCVPISNHLYFYWYRQILGQKV<br>EFLVSFYNNEISEKSEIFDDQFSVERPDGSNFTLKIRSTKLEDSAMYFCASTPRSSYEQYFG<br>PGTRLTVTEDLNKVFPPEVAVFEPSEAEISHTQKATLVCLATGFFPDHVELSWWVNGKEVHS<br>GVCTDPQPLKEQPALNDSRYCLSSRLRVSATFWQNPRNHFRCQVQFYGLSENDEWTQDRAKP<br>VTQIVSAEAWGRADCGFTSVSYQQGVLSATILYEILLGKATLYAVLVSALVLMAMVKRKDFG<br>SGATNFSLLKQAGDVEENPGPMMISLRVLLVILWLQLSWVWSQRKEVEQDPGPFNVPEGATV<br>AFNCTYSNSASQSFFWYRQDCRKEPKLLMSVYSSGNEDGRFTAQLNRASQYISLLIRDSKLS<br>DSATYLCVVNRDNYGQNFVFGPGTRLSVLPNIQNPDPAVYQLRDSKSSDKSVCLFTDFDSQT<br>NVSQSKDSDVYITDKCVLDMRSMDFKSNSAVAWSNKSDFACANAFNNSIIPEDTFFPSPESS<br>CDVKLVEKSFETDTNLNFQNLSVIGFRILLLKVAGFNLLMTLRLWSS | TCR 58 Full sequence with human constant (aa) |
| 96 | MDTWLVCWAIFSLLKAGLTEPEVTQTPSHQVTQMGQEVILRCVPISNHLYFYWYRQILGQKV<br>EFLVSFYNNEISEKSEIFDDQFSVERPDGSNFTLKIRSTKLEDSAMYFCASTPRSSYEQYFG<br>PGTRLTVTEDLRNVTPPKVSLFEPSKAEIANKQKATLVCLARGFFPDHVELSWWVNGKEVHS<br>GVCTDPQAYKESNYSYCLSSRLRVSATFWHNPRNHFRCQVQFHGLSEEDKWPEGSPKPVTQN<br>ISAEAWGRADCGITSASYQQGVLSATILYEILLGKATLYAVLVSTLVVMAMVKRKNSGSAT<br>NFSLLKQAGDVEENPGPMMISLRVLLVILWLQLSWVWSQRKEVEQDPGPFNVPEGATVAFNC<br>TYSNSASQSFFWYRQDCRKEPKLLMSVYSSGNEDGRFTAQLNRASQYISLLIRDSKLSDSAT<br>YLCVVNRDNYGQNFVFGPGTRLSVLPNIQNPEPAVYQLKDPRSQDSTLCLFTDFDSQINVPK<br>TMESGTFITDKCVLDMKAMDSKSNGAIAWSNQTSFTCQDIFKETNATYPSSDVPCDATLTEK<br>SFETDMNLNFQNLLVIVLRILLLKVAGFNLLMTLRLWSS | TCR 58 Full sequence with mouse constant (aa) |
| 97 | ATGAAGAGGGAGAGGGAGATGCTACTCATCACATCAATGTTGGTCTTATGGATGCAATTGTC<br>ACAGGTAATGGACAACAGGTAATGCAAATTCCTCAGTACCAGCATGTACAAGAAGGAGAGG<br>ACTTCACCACGTACTGCAATTCCTCAACTACTTTAAGCAATATACAGTGGTATAAGCAAAGG<br>CCTGGTGGACATCCCGTTTTTTTGATACAGTTAGTGAAGAGTGGAGAAGTGAAGAAGCAGAA<br>AAGACTGACATTTCAGTTTGGAGAAGCAAAAAAGAACAGCTCCCTGCACATCACAGCCACCC<br>AGACTACAGATGTAGGAACCTACTTCTGTGCACCCAAGCGGAATATGGAAACAAACTGGTC<br>TTTGGCGCAGGAACCATTCTGAGAGTCAAGTCCAATATCCAGAATCCGGACCccgcggtata<br>tcaactgcgcgactcaaaatcatccgataagagtgtctgtttgtttactgacttcgacagtc<br>aaactaatgtctctcagagcaaagattccgatgtctacatcactgacaagtgcgttctggat<br>atgcggagcatggattttaagtccaactccgccgtagcctggtccaacaagtcagactttgc<br>ctgtgcaaatgctttcaacaactcaattatccctgaggacactttcttcctcaccggagt<br>cctcatgcgatgttaaactggtcgaaaaatcttttgagacggatacgaacctcaacttccaa<br>aatttgagcgttattggctttaggattctgcttctcaaggttgcgggttcaatctcctgat<br>gacgttgcggctttggagcagctaa | TCR 59 Alpha Native with Codon Optimized Human Constant (nt) |
| 98 | ATGAAGAGGGAGAGGGAGATGCTACTCATCACATCAATGTTGGTCTTATGGATGCAATTGTC<br>ACAGGTAATGGACAACAGGTAATGCAAATTCCTCAGTACCAGCATGTACAAGAAGGAGAGG<br>ACTTCACCACGTACTGCAATTCCTCAACTACTTTAAGCAATATACAGTGGTATAAGCAAAGG<br>CCTGGTGGACATCCCGTTTTTTTGATACAGTTAGTGAAGAGTGGAGAAGTGAAGAAGCAGAA<br>AAGACTGACATTTCAGTTTGGAGAAGCAAAAAAGAACAGCTCCCTGCACATCACAGCCACCC<br>AGACTACAGATGTAGGAACCTACTTCTGTGCACCCAAGCGGGAATATGGAAACAAACTGGTC<br>TTTGGCGCAGGAACCATTCTGAGAGTCAAGTCCAATATCCAGAATCCGGAGCCTGCCGTGTA<br>CCAGCTGAAGGACCCACGGAGCCAGGATAGCACCCTGTGCCTGTTCACCGACTTTGATTCTC<br>AGATCAACGTGCCCAAGACCATGGAGAGCGGCACCTTCATCACAGACAAGTGCGTGCTGGAT<br>ATGAAGGCCATGGACAGCAAGTCCAACGGCGCCATCGCCTGGTCCAATCAGACATCTTTCAC<br>CTGCCAGGATATCTTTAAGGAGACAAATGCCACCTATCCTTCCTCTGACGTGCCATGTGATG<br>CCACCCTGACAGAGAAGAGCTTCGAGACCGACATGAACCTGAATTTTCAGAATCTGCTCGTG<br>ATTGTCCTGAGAATCCTGCTGCTGAAGGTGGCCGGCTTTAACCTGCTGATGACCCTGAGGCT<br>GTGGAGCTCCTGA | TCR 59 Alpha Native with Codon Optimized Mouse Constant (nt) |
| 99 | GQQVMQIPQYQHVQEGEDFTTYCNSSTTLSNIQWYKQRPGGHPVFLIQLVKSGEVKKQKRLT<br>FQFGEAKKNSSLHITATQTTDVGTYFCAPKREYGNKLVFGAGTILRVKSNIQNPDPAVYQLR<br>DSKSSDKSVCLFTDFDSQTNVSQSKDSDVYITDKCVLDMRSMDFKSNSAVAWSNKSDFACAN<br>AFNNSIIPEDTFFPSPESSCDVKLVEKSFETDTNLNFQNLSVIGFRILLLKVAGFNLLMTLR<br>LWSS | TCR 59 Alpha with Codon Optimized Human Constant (aa) |
| 100 | GQQVMQIPQYQHVQEGEDFTTYCNSSTTLSNIQWYKQRPGGHPVFLIQLVKSGEVKKQKRLT<br>FQFGEAKKNSSLHITATQTTDVGTYFCAPKREYGNKLVFGAGTILRVKSNIQNPEPAVYQLK<br>DPRSQDSTLCLFTDFDSQINVPKTMESGTFITDKCVLDMKAMDSKSNGAIAWSNQTSFTCQD<br>IFKETNATYPSSDVPCDATLTEKSFETDMNLNFQNLLVIVLRILLLKVAGFNLLMTLRLWSS | TCR 59 Alpha with Codon Optimized Mouse Constant (aa) |

SEQUENCE TABLE

| SEQ ID NO | SEQUENCE | Description |
|---|---|---|
| 101 | MKREREMLLITSMLVLWMQLSQVNGQQVMQIPQYQHVQEGEDFTTYCNSSTTLSNIQWYKQR PGGHPVFLIQLVKSGEVKKQKRLTFQFGEAKKNSSLHITATQTTDVGTYFCAPKREYGNKLV FGAGTILRVKSNIQNPDPAVYQLRDSKSSDKSVCLFTDFDSQTNVSQSKDSDVYITDKCVLD MRSMDFKSNSAVAWSNKSDFACANAFNNSIIPEDTFFPSPESSCDVKLVEKSFETDTNLNFQ NLSVIGFRILLLKVAGFNLLMTLRLWSS | TCR 59 Alpha with Codon Optimized Human Constant and signal peptide (aa) |
| 102 | MKREREMLLITSMLVLWMQLSQVNGQQVMQIPQYQHVQEGEDFTTYCNSSTTLSNIQWYKQR PGGHPVFLIQLVKSGEVKKQKRLTFQFGEAKKNSSLHITATQTTDVGTYFCAPKREYGNKLV FGAGTILRVKSNIQNPEPAVYQLKDPRSQDSTLCLFTDFDSQINVPKTMESGTFITDKCVLD MKAMDSKSNGAIAWSNQTSFTCQDIFKETNATYPSSDVPCDATLTEKSFETDMNLNFQNLLV IVLRILLLKVAGFNLLMTLRLWSS | TCR 59 Alpha with Codon Optimized Mouse Constant and signal peptide (aa) |
| 103 | GQQVMQIPQYQHVQEGEDFTTYCNSSTTLSNIQWYKQRPGGHPVFLIQLVKSGEVKKQKRLT FQFGEAKKNSSLHITATQTTDVGTYFCAPKREYGNKLVFGAGTILRVKS | TCR 59 Alpha variable region (aa) |
| 104 | TTISN | TCR 59 Alpha CDR1 (aa) |
| 105 | INKSGEV | TCR 59 Alpha CDR2 (aa) |
| 106 | APKREYGNKLV | TCR 59 Alpha CDR3 (aa) |
| 107 | MKREREMLLITSMLVLWMQLSQVN | TCR 59 Alpha Signal peptide (aa) |
| 108 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCTATTCGGGCAGGGCCTCCTACGAGCAGTACTTCGGG CCGGGCACCAGGCTCACGGTCACAgaggacctgaataaggtgttccccctgaggtggccgt gtttgagccaagcgaggccgagatctcccacacccagaaggccaccctggtgtgcctggca ccggcttcttttcccgatcacgtggagctgtcctggtgggtgaacggcaaggaggtgcactct ggcgtgtgcacagacccacagccccgaaggagcagcctgccctgaatgattccgctattg tctgtcctctcggctgagagtgtctgccacctttggcagaacccacggaatcacttcagat gccaggtgcagttttacggcctgtctgagaacgagtgaacaccaggatcgggccaagtct gtgacacagatcgtgagcgcggaagcatggggcagagccgactgtggcttcaccagcgtgtc ctatcagcagggcgtgctgtccgccaccatcctgtacgagatcctgctgggcaaggccacac tgtatgccgtgctggtgtctgccctggtgctgatggccatggtgaagagaaaagacttctaa | TCR 59 Beta Native with Codon Optimized Human Constant (nt) |
| 109 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCTATTCGGGCAGGGCCTCCTACGAGCAGTACTTCGGG CCGGGCACCAGGCTCACGGTCACAGAGGACCTGCGCAATGTGACCCCCCCTAAGGTGTCCCT GTTTGAGCCCCTCTAAGGCCGAGATCGCCAACAAGCAGAAGGCCACCCTGGTGTGCCTGGCCA GAGGCTTCTTCCCTGATCACGTGGAGCTGAGCTGGTGGGTGAATGGCAAGGAGGTGCACTCC GGCGTGTGCACCGACCCACAGGCCTACAAGGAGTCCAACTACTCTTATTGTCTGTCCTCTAG GCTGCGCGTGAGCGCCACATTCTGGCACAACCCTCGGAATCACTTCAGATGCCAGGTGCAGT TTCACGGCCTGAGCGAGGAGGATAAGTGGCCAGAGGGCTCCCCAAAGCCCGTGACCCAGAAT ATCTCTGCCGAGGCATGGGGCAGGGCCGACTGTGGAATCACCTCCGCTCTTATCAGCAGGG CGTGCTGTCCGCCACAATCCTGTACGAGATCCTGCTGGGCAAGGCCACCCTGTATGCCGTGC TGGTGTCCACACTGGTGGTCATGGCCATGGTGAAGCGCAAGAACAGCtaa | TCR 59 Beta Native with Codon Optimized Mouse Constant (nt) |
| 110 | EPEVTQTPSHQVTQMGQEVILRCVPISNHLYFYWYRQILGQKVEFLVSFYNNEISEKSEIFD DQFSVERPDGSNFTLKIRSTKLEDSAMYFCAYSGRASYEQYFGPGTRLTVTEDLNKVFPPEV AVFEPSEAEISHTQKATLVCLATGFFPDHVELSWWVNGKEVHSGVCTDPQPLKEQPALNDSR YCLSSRLRVSATFWQNPRNHFRCQVQFYGLSENDEWTQDRAKPVTQIVSAEAWGRADCGFTS VSYQQGVLSATILYEILLGKATLYAVLVSALVLMAMVKRKDF | TCR 59 Beta with Codon Optimized Human Constant (aa) |
| 111 | EPEVTQTPSHQVTQMGQEVILRCVPISNHLYFYWYRQILGQKVEFLVSFYNNEISEKSEIFD DQFSVERPDGSNFTLKIRSTKLEDSAMYFCAYSGRASYEQYFGPGTRLTVTEDLRNVTPPKV | TCR 59 Beta with Codon |

SEQUENCE TABLE

| SEQ ID NO | SEQUENCE | Description |
|---|---|---|
| | SLFEPSKAEIANKQKATLVCLARGFFPDHVELSWWVNGKEVHSGVCTDPQAYKESNYSYCLS SRLRVSATFWHNPRNHFRCQVQFHGLSEEDKWPEGSPKPVTQNISAEAWGRADCGITSASYQ QGVLSATILYEILLGKATLYAVLVSTLVVMAMVKRKNS | Optimized Mouse Constant (aa) |
| 112 | MDTWLVCWAIFSLLKAGLTEPEVTQTPSHQVTQMGQEVILRCVPISNHLYFYWYRQILGQKV EFLVSFYNNEISEKSEIFDDQFSVERPDGSNFTLKIRSTKLEDSAMYFCAYSGRASYEQYFG PGTRLTVTEDLNKVFPPEVAVFEPSEAEISHTQKATLVCLATGFFPDHVELSWWVNGKEVHS GVCTDPQPLKEQPALNDSRYCLSSRLRVSATFWQNPRNHFRCQVQFYGLSENDEWTQDRAKP VTQIVSAEAWGRADCGFTSVSYQQGVLSATILYEILLGKATLYAVLVSALVLMAMVKRKDF | TCR 59 Beta with Codon Optimized Human Constant and signal peptide (aa) |
| 113 | MDTWLVCWAIFSLLKAGLTEPEVTQTPSHQVTQMGQEVILRCVPISNHLYFYWYRQILGQKV EFLVSFYNNEISEKSEIFDDQFSVERPDGSNFTLKIRSTKLEDSAMYFCAYSGRASYEQYFG PGTRLTVTEDLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPEGSPKPVTQN ISAEAWGRADCGITSASYQQGVLSATILYEILLGKATLYAVLVSTLVVMAMVKRKNS | TCR 59 Beta with Codon Optimized Mouse Constant and signal peptide (aa) |
| 114 | EPEVTQTPSHQVTQMGQEVILRCVPISNHLYFYWYRQILGQKVEFLVSFYNNEISEKSEIFD DQFSVERPDGSNFTLKIRSTKLEDSAMYFCAYSGRASYEQYFGPGTRLTVT | TCR 59 Beta variable region (aa) |
| 115 | AYSGRASYEQY | TCR 59 Beta CDR3 (aa) |
| 116 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCTATTCGGGCAGGGCCTCCTACGAGCAGTACTTCGGG CCGGGCACCAGGCTCACGGTCACAgaggacctgaataaggtgttcccccctgaggtggccgt gtttgagccaagcgaggccgagatctcccacacccagaaggccaccctggtgtgcctggcaa ccggcttcttcccgatcacgtggagctgtcctggtgggtgaacggcaaggaggtgcactct ggcgtgtgcacagacccacagcccctgaaggagcagcctgccctgaatgattcccgctattg tctgtcctctcggctgagagtgtctgccacctttggcagaacccacggaatcacttcagat gccaggtgcagttttacggcctgtctgagaacgacgagtggacccaggatcgggccaagcct gtgacacagatcgtgagcgcggaagcatggggcagagccgactgtggcttcaccagcgtgtc ctatcagcagggcgtgctgtccgccaccatcctgtacgagatcctgctgggcaaggccacac tgtatgccgtgctggtgtctgccctggtgctgatggccatggtgaagagaaaagacttctaa ggctccggagcaaccaatttcagcctgctgaagcaggccggcgatgtggaggagaatcctgg cccaATGAAGAGGGAGAGGGAGATGCTACTCATCACATCAATGTTGGTCTTATGGATGCAAT TGTCACAGGTGAATGGACAACAGGTAATGCAAATTCCTCAGTACCAGCATGTACAAGAAGGA GAGGACTTCACCACGTACTGCAATTCCTCAACTACTTTAAGCAATATACAGTGGTATAAGCA AAGGCCTGGTGGACATCCCGTTTTTTTGATACAGTTAGTGAAGAGTGGAGAAGTGAAGAAGC AGAAAAGACTGACATTTCAGTTTGGAGAAGCAAAAAAGAACAGCTCCCTGCACATCACAGCC ACCCAGACTACAGATGTAGGAACCTACTTCTGTGCACCCAAGCGGGAATATGGAAACAAACT GGTCTTTGGCGCAGGAACCATTCTGAGAGTCAAGTCCAATATCCAGAATCCGGACCccgcgg tatatcaactgcgcgactcaaaatcatccgataagagtgtctgtttgtttactgacttcgac agtcaaactaatgtctctcagagcaaagattccgatgtctacatcactgacaagtgcgttct ggatatgcgggagcatggatttaagtccaactccgccgtagcctggtccaacaagtcagact tgcctgtgcaaatgctttcaacaactcaattatccctgaggacactttctttccttcaccg gagtcctcatgcgatgttaaactggtcgaaaaatcttttgagacggatacgaacctcaactt ccaaaatttgagcgttattggctttaggattctgcttctcaaggttgcggggttcaatctcc tgatgacgttgcggctttggagcagctaa | TCR 59 Native full sequence with human constant (nt) |
| 117 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCTATTCGGGCAGGGCCTCCTACGAGCAGTACTTCGGG CCGGGCACCAGGCTCACGGTCACAGAGGACCTGCGCAATGTGACCCCCCCTAAGGTGTCCCT GTTTGAGCCCTCAAGGCCGAGATCGCCAACAAGCAGAAGGCCACCCTGGTGTGCCTGGCCA GAGGCTTCTTCCCTGATCACGTGGAGCTGAGCTGGTGGGTGAATGGCAAGGAGGTGCACTCC GGCGTGTGCACCGACCCACAGGCCTACAAGGAGTCCAACTACTCTTATTGTCTGTCCTCTAG GCTGCGCGTGAGCGCCACATTCTGGCACAACCCTCGGAATCACTTCAGATGCCAGGTGCAGT TCACGGCCTGAGCGAGGAGGATAAGTGGCCAGAGGGCTCCCCAAAGCCCGTGACCCAGAAT ATCTCTGCCGAGGCATGGGGCAGGGCCGACTGTGGAATCACCTCCGCCTCTTATCAGCAGGG CGTGCTGTCCGCCACAATCCTGTACGAGATCCTGCTGGGCAAGGCCACCCTGTATGCCGTGC TGGTGTCCACACTGGTGGTCATGGCCATGGTGAAGCGCAAGAACAGCtaaggctccggagca accaatttcagcctgctgaagcaggccggcgatgtggaggagaatcctggcccaATGAAGAG | TCR 59 Native full sequence with mouse constant (nt) |

SEQUENCE TABLE

| SEQ ID NO | SEQUENCE | Description |
|---|---|---|
| | GGAGAGGGAGATGCTACTCATCACATCAATGTTGGTCTTATGGATGCAATTGTCACAGGTGA<br>ATGGACAACAGGTAATGCAAATTCCTCAGTACCAGCATGTACAAGAAGGAGAGGACTTCACC<br>ACGTACTGCAATTCCTCAACTACTTTAAGCAATATACAGTGGTATAAGCAAAGGCCTGGTGG<br>ACATCCCGTTTTTTTGATACAGTTAGTGAAGAGTGGAGAAGTGAAGAAGCAGAAAAGACTGA<br>CATTTCAGTTTGGAGAAGCAAAAAGAACAGCTCCCTGCACATCACAGCCACCCAGACTACA<br>GATGTAGGAACCTACTTCTGTGCACCCAAGCGGGAATATGGAAACAAACTGGTCTTTGGCGC<br>AGGAACCATTCTGAGAGTCAAGTCCAATATCCAGAATCCGGACCCTGCCGTGTACCAGCTGA<br>AGGACCCACGGAGCCAGGATAGCACCCTGTGCCTGTTCACCGACTTTGATTCTCAGATCAAC<br>GTGCCCAAGACCATGGAGAGCGGCACCTTCATCACAGACAAGTGCGTGCTGGATATGAAGGC<br>CATGGACAGCAAGTCCAACGGCGCCATCGCCTGGTCCAATCAGACATCTTTCACCTGCCAGG<br>ATATCTTTAAGGAGACAAATGCCACCTATCCTTCCTCTGACGTGCCATGTGATGCCACCCTG<br>ACAGAGAAGAGCTTCGAGACCGACATGAACCTGAATTTTCAGAATCTGCTCGTCGATTGTCCT<br>GAGAATCCTGCTGCTGAAGGTGGCCGGCTTTAACCTGCTGATGACCCTGAGGCTGTGGAGCT<br>CCTGA | |
| 118 | MDTWLVCWAIFSLLKAGLTEPEVTQTPSHQVTQMGQEVILRCVPISNHLYFYWYRQILGQKV<br>EFLVSFYNNEISEKSEIFDDQFSVERPDGSNFTLKIRSTKLEDSAMYFCAYSGRASYEQYFG<br>PGTRLTVTEDLNKVFPPEVAVFEPSEAEISHTQKATLVCLATGFFPDHVELSWWVNGKEVHS<br>GVCTDPQPLKEQPALNDSRYCLSSRLRVSATFWQNPRNHFRCQVQFYGLSENDEWTQDRAKP<br>VTQIVSAEAWGRADCGFTSVSYQQGVLSATILYEILLGKATLYAVLVSALVLMAMVKRKDFG<br>SGATNFSLLKQAGDVEENPGPMKREREMLLITSMLVLWMQLSQVNGQQVMQIPQYQHVQEGE<br>DFTTYCNSSTTLSNIQWYKQRPGGHPVFLIQLVKSGEVKKQKRLTFQFGEAKKNSSLHITAT<br>QTTDVGTYFCAPKREYGNKLVFGAGTILRVKSNIQNPDPAVYQLRDSKSSDKSVCLFTDFDS<br>QTNVSQSKDSDVYITDKCVLDMRSMDFKSNSAVAWSNKSDFACANAFNNSIIPEDTFFPSPE<br>SSCDVKLVEKSFETDTNLNFQNLSVIGFRILLLKVAGFNLLMTLRLWSS | TCR 59 Full sequence with human constant (aa) |
| 119 | MDTWLVCWAIFSLLKAGLTEPEVTQTPSHQVTQMGQEVILRCVPISNHLYFYWYRQILGQKV<br>EFLVSFYNNEISEKSEIFDDQFSVERPDGSNFTLKIRSTKLEDSAMYFCAYSGRASYEQYFG<br>PGTRLTVTEDLRNVTPPKVSLFEPSKAEIANKQKATLVCLARGFFPDHVELSWWVNGKEVHS<br>GVCTDPQAYKESNYSYCLSSRLRVSATFWHNPRNHFRCQVQFHGLSEEDKWPEGSPKPVTQN<br>ISAEAWGRADCGITSASYQQGVLSATILYEILLGKATLYAVLVSTLVVMAMVKRKNSGSAT<br>NFSLLKQAGDVEENPGPMKREREMLLITSMLVLWMQLSQVNGQQVMQIPQYQHVQEGEDFTT<br>YCNSSTTLSNIQWYKQRPGGHPVFLIQLVKSGEVKKQKRLTFQFGEAKKNSSLHITATQTTD<br>VGTYFCAPKREYGNKLVFGAGTILRVKSNIQNPEPAVYQLKDPRSQDSTLCLFTDFDSQINV<br>PKTMESGTFITDKCVLDMKAMDSKSNGAIAWSNQTSFTCQDIFKETNATYPSSDVPCDATLT<br>EKSFETDMNLNFQNLLVIVLRILLLKVAGFNLLMTLRLWSS | TCR 59 Full sequence with mouse constant (aa) |
| 120 | ATGATGAAATCCTTGAGAGTTTTACTAGTGATCCTGTGGCTTCAGTTGAGCTGGGTTTGGAG<br>CCAACAGAAGGAGGTGGAGCAGAATTCTGGACCCCTCAGTGTTCCAGAGGGAGCCATTGCCT<br>CTCTCAACTGCACTTACAGTGACCGAGGTTCCCAGTCCTTCTTCTGGTACAGACAATATTCT<br>GGGAAAAGCCCTGAGTTGATAATGTTCATATACTCCAATGGTGACAAAGAAGATGGAAGGTT<br>TACAGCACAGCTCAATAAAGCCAGCCAGTATGTTTCTCTGCTCATCAGAGACTCCCAGCCCA<br>GTGATTCAGCCACCTACCTCTGTGCCGTGAACATGTTGGGGAGTGGAGGTAGCAACTATAAA<br>CTGACATTTGGAAAAGGAACTCTCTTAACCGTGAATCCAAATATCCAGAATCCGGACCccgc<br>ggtatatcaactcgcgactcaaaatcatccgataagagtgtctgtttgtttactgacttcg<br>acagtcaaactaatgtctctcagagcaaagattccgatgtctacatcactgacaagtgcgtt<br>ctggatatgcggagcatggattttaagtccaactccgccgtagcctggtccaacaagtcaga<br>cttttgcctgtgcaaatgctttcaacaactcaattatccctgaggacacttctttccttcac<br>cggagtcctcatgcgatgttaaactggtcgaaaaatctttttgagacggatacgaacctcaac<br>ttccaaaatttgagcgttattggctttaggattctgcttctcaaggttgcggggttcaatct<br>cctgatgacgttgcggcttttggagcagctaa | TCR 60 Alpha Native with Codon Optimized Human Constant (nt) |
| 121 | ATGATGAAATCCTTGAGAGTTTTACTAGTGATCCTGTGGCTTCAGTTGAGCTGGGTTTGGAG<br>CCAACAGAAGGAGGTGGAGCAGAATTCTGGACCCCTCAGTGTTCCAGAGGGAGCCATTGCCT<br>CTCTCAACTGCACTTACAGTGACCGAGGTTCCCAGTCCTTCTTCTGGTACAGACAATATTCT<br>GGGAAAAGCCCTGAGTTGATAATGTTCATATACTCCAATGGTGACAAAGAAGATGGAAGGTT<br>TACAGCACAGCTCAATAAAGCCAGCCAGTATGTTTCTCTGCTCATCAGAGACTCCCAGCCCA<br>GTGATTCAGCCACCTACCTCTGTGCCGTGAACATGTTGGGGAGTGGAGGTAGCAACTATAAA<br>CTGACATTTGGAAAAGGAACTCTCTTAACCGTGAATCCAAATATCCAGAATCCGGAGCCTGC<br>CGTGTACCAGCTGAAGGACCCACGGAGCCAGGATAGCACCCTGTGCCTGTTCACCGACTTTG<br>ATTCTCAGATCAACGTGCCCAAGACCATGGAGAGCGGCACCTTCATCACAGACAAGTGCGTG<br>CTGGATATGAAGGCCATGGACAGCAAGTCCAACGGCGCCATCGCCTGGTCCAATCAGACATC<br>TTTCACCTGCCAGGATATCTTTAAGGAGACAAATGCCACCTATCCTTCCTCTGACGTGCCAT<br>GTGATGCCACCCTGACAGAGAAGAGCTTCGAGACCGACATGAACCTGAATTTTCAGAATCTG<br>CTCGTGATTGTCCTGAGAATCCTGCTGCTGAAGGTGGCCGGCTTTAACCTGCTGATGACCCT<br>GAGGCTGTGGAGCTCCTGA | TCR 60 Alpha Native with Codon Optimized Mouse Constant (nt) |
| 122 | QKEVEQNSGPLSVPEGAIASLNCTYSDRGSQSFFWYRQYSGKSPELIMFIYSNGDKEDGRFT<br>AQLNKASQYVSLLIRDSQPSDSATYLCAVNMLGSGGSNYKLTFGKGTLLTVNPNIQNPDPAV<br>YQLRDSKSSDKSVCLFTDFDSQTNVSQSKDSDVYITDKCVLDMRSMDFKSNSAVAWSNKSDF<br>ACANAFNNSIIPEDTFFPSPESSCDVKLVEKSFETDTNLNFQNLSVIGFRILLLKVAGFNLL<br>MTLRLWSS | TCR 60 Alpha with Codon Optimized Human Constant (aa) |

| SEQ ID NO | SEQUENCE | Description |
|---|---|---|
| 123 | QKEVEQNSGPLSVPEGAIASLNCTYSDRGSQSFFWYRQYSGKSPELIMFIYSNGDKEDGRFT AQLNKASQYVSLLIRDSQPSDSATYLCAVNMLGSGGSNYKLTFGKGTLLTVNPNIQNPEPAV YQLKDPRSQDSTLCLFTDFDSQINVPKTMESGTFITDKCVLDMKAMDSKSNGAIAWSNQTSF TCQDIFKETNATYPSSDVPCDATLTEKSFETDMNLNFQNLLVIVLRILLLKVAGFNLLMTLR LWSS | TCR 60 Alpha with Codon Optimized Mouse Constant (aa) |
| 124 | MMKSLRVLLVILWLQLSWVWSQQKEVEQNSGPLSVPEGAIASLNCTYSDRGSQSFFWYRQYS GKSPELIMFIYSNGDKEDGRFTAQLNKASQYVSLLIRDSQPSDSATYLCAVNMLGSGGSNYK LTFGKGTLLTVNPNIQNPDPAVYQLRDSKSSDKSVCLFTDFDSQTNVSQSKDSDVYITDKCV LDMRSMDFKSNSAVAWSNKSDFACANAFNNSIIPEDTFFPSPESSCDVKLVEKSFETDTNLN FQNLSVIGFRILLLKVAGFNLLMTLRLWSS | TCR 60 Alpha with Codon Optimized Human Constant and signal peptide (aa) |
| 125 | MMKSLRVLLVILWLQLSWVWSQQKEVEQNSGPLSVPEGAIASLNCTYSDRGSQSFFWYRQYS GKSPELIMFIYSNGDKEDGRFTAQLNKASQYVSLLIRDSQPSDSATYLCAVNMLGSGGSNYK LTFGKGTLLTVNPNIQNPEPAVYQLKDPRSQDSTLCLFTDFDSQINVPKTMESGTFITDKCV LDMKAMDSKSNGAIAWSNQTSFTCQDIFKETNATYPSSDVPCDATLTEKSFETDMNLNFQNL LVIVLRILLLKVAGFNLLMTLRLWSS | TCR 60 Alpha with Codon Optimized Mouse Constant and signal peptide (aa) |
| 126 | QKEVEQNSGPLSVPEGAIASLNCTYSDRGSQSFFWYRQYSGKSPELIMFIYSNGDKEDGRFT AQLNKASQYVSLLIRDSQPSDSATYLCAVNMLGSGGSNYKLTFGKGTLLTVNP | TCR 60 Alpha variable region (aa) |
| 127 | DRGSQS | TCR 60, 61 Alpha CDR1 (aa) |
| 128 | IYSNGD | TCR 60, 61 Alpha CDR2 (aa) |
| 129 | AVNMLGSGGSNYKLT | TCR 60 Alpha CDR3 (aa) |
| 130 | MMKSLRVLLVILWLQLSWVWSQ | TCR 60, 61 Alpha Signal peptide (aa) |
| 131 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCATCAGTCGGACAGTCTCCTACGAGCAGTACTTCGGG CCGGGCACCAGGCTCACGGTCACAgaggacctgaataaggtgttcccccctgaggtggcgt gtttgagccaagcgaggccgagatctcccacacccagaaggccacctggtgtgcctggcaa ccggcttcttccctgatcacgtggagctgtcctggtgggtgaacggcaaggaggtgcactct ggcctgtgcacagacccacagccctgaaggagcagcctgccctgaatgattcccgctattg tctgtcctctcggctgagagtgtctgccacctttggcagaacccacggaatcacttcagat gccaggtgcagttttacggcctgtctgagaacgacgagtggacccaggatcgggccaagcct gtgacacagatcgtgagcgcggaagcatggggcagagccgactgtggcttcaccagcgtgtc ctatcagcagggcgtgctgtccgccaccatcctgtacgagatcctgctgggcaaggccacac tgtatgccgtgctggtgtctgccctggtgctgatggccatggtgaagagaaaagacttctaa | TCR 60 Beta Native with Codon Optimized Human Constant (nt) |
| 132 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCATCAGTCGGACAGTCTCCTACGAGCAGTACTTCGGG CCGGGCACCAGGCTCACGGTCACAGAGGACCTGCGCAATGTGACCCCCCCTAAGGTGTCCCT GTTTGAGCCCTCTAAGGCCGAGATCGCCAACAAGCAGAAGGCCACCCTGGTGTGCCTGGCCA GAGGCTTCTTCCCTGATCACGTGGAGCTGAGCTGGTGGGTGAATGGCAAGGAGGTGCACTCC GGCGTGTGCACCGACCCACAGGCCTACAAGGAGTCCAACTACTCTTATTGTCTGTCCTCTAG GCTGCGCGTGAGCGCCACATTCTGGCACAACCCTCGGAATCACTTCAGATGCCAGGTGCAGT TCACGGCCTGAGCGAGGAGGATAAGTGGCCAGAGGGCTCCCCAAAGCCCGTGACCCAGAAT ATCTCTGCCGAGGCATGGGGCAGGGCCGACTGTGGAATCACCTCCGCCTCTTATCAGCAGGG CGTGCTGTCCGCCACAATCCTGTACGAGATCCTGCTGGGCAAGGCCACCCTGTATGCCGTGC TGGTGTCCACACTGGTGGTCATGGCCATGGTGAAGCGCAAGAACAGCtaa | TCR 60 Beta Native with Codon Optimized Mouse Constant (nt) |

SEQUENCE TABLE

| SEQ ID NO | SEQUENCE | Description |
|---|---|---|
| 133 | EPEVTQTPSHQVTQMGQEVILRCVPISNHLYFYWYRQILGQKVEFLVSFYNNEISEKSEIFD DQFSVERPDGSNFTLKIRSTKLEDSAMYFCAISRTVSYEQYFGPGTRLTVTEDLNKVFPPEV AVFEPSEAEISHTQKATLVCLATGFFPDHVELSWWVNGKEVHSGVCTDPQPLKEQPALNDSR YCLSSRLRVSATFWQNPRNHFRCQVQFYGLSENDEWTQDRAKPVTQIVSAEAWGRADCGFTS VSYQQGVLSATILYEILLGKATLYAVLVSALVLMAMVKRKDF | TCR 60 Beta with Codon Optimized Human Constant (aa) |
| 134 | EPEVTQTPSHQVTQMGQEVILRCVPISNHLYFYWYRQILGQKVEFLVSFYNNEISEKSEIFD DQFSVERPDGSNFTLKIRSTKLEDSAMYFCAISRTVSYEQYFGPGTRLTVTEDLRNVTPPKV SLFEPSKAEIANKQKATLVCLARGFFPDHVELSWWVNGKEVHSGVCTDPQAYKESNYSYCLS SRLRVSATFWHNPRNHFRCQVQFHGLSEEDKWPEGSPKPVTQNISAEAWGRADCGITSASYQ QGVLSATILYEILLGKATLYAVLVSTLVVMAMVKRKNS | TCR 60 Beta with Codon Optimized Mouse Constant (aa) |
| 135 | MDTWLVCWAIFSLLKAGLTEPEVTQTPSHQVTQMGQEVILRCVPISNHLYFYWYRQILGQKV EFLVSFYNNEISEKSEIFDDQFSVERPDGSNFTLKIRSTKLEDSAMYFCAISRTVSYEQYFG PGTRLTVTEDLNKVFPPEVAVFEPSEAEISHTQKATLVCLATGFFPDHVELSWWVNGKEVHS GVCTDPQPLKEQPALNDSRYCLSSRLRVSATFWQNPRNHFRCQVQFYGLSENDEWTQDRAKP VTQIVSAEAWGRADCGFTSVSYQQGVLSATILYEILLGKATLYAVLVSALVLMAMVKRKDF | TCR 60 Beta with Codon Optimized Human Constant and signal peptide (aa) |
| 136 | MDTWLVCWAIFSLLKAGLTEPEVTQTPSHQVTQMGQEVILRCVPISNHLYFYWYRQILGQKV EFLVSFYNNEISEKSEIFDDQFSVERPDGSNFTLKIRSTKLEDSAMYFCAISRTVSYEQYFG PGTRLTVTEDLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPEGSPKPVTQN ISAEAWGRADCGITSASYQQGVLSATILYEILLGKATLYAVLVSTLVVMAMVKRKNS | TCR 60 Beta with Codon Optimized Mouse Constant and signal peptide (aa) |
| 137 | EPEVTQTPSHQVTQMGQEVILRCVPISNHLYFYWYRQILGQKVEFLVSFYNNEISEKSEIFD DQFSVERPDGSNFTLKIRSTKLEDSAMYFCAISRTVSYEQYFGPGTRLTVT | TCR 60 Beta variable region (aa) |
| 138 | AISRTVSYEQY | TCR 60 Beta CDR3 (aa) |
| 139 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCATCAGTCGGACAGTCTCCTACGAGCAGTACTTCGGG CCGGGCACCAGGCTCACGGTCACAgaggacctgaataaggtgttcccccctgaggtggccgt gtttgagccaagcgaggccgagatctcccacacccagaaggccaccctggtgtgcctggcaa ccggcttctttcccgatcacgtggagctgtcctggtgggtgaacggcaaggaggtgcactct ggcgtgtgcacagacccacagcccctgaaggagcagcctgaatgattcccgctattg tctgtcctctcggctgagagtgtctgccaccttttggcagaacccacggaatcacttcagat gccaggtgcagttttacggcctgtctgagaacgacgagtggacccaggatcgggccaagcct gtgacacagatcgtgagcgcggaagcatggggcagagccgactgtggcttcaccagcgtgtc ctatcagcagggcgtgctgtccgccaccatcctgtacgagatcctgctgggcaaggccacac tgtatgccgtgctggtgtctgccctggtgctgatggccatggtgaagagaaaagacttctaa ggctccggagcaaccaatttcagctgctgaagcaggccggcgatgtggaggagaatcctggg cccaATGATGAAATCCTTGAGAGTTTTACTAGTGATCCTGTGGCTTCAGTTGAGCTGGGTTT GGAGCCAACAGAAGGAGGTGGAGCAGAATTCTGGACCCCTCAGTGTTCCAGAGGGAGCCATT GCCTCTCTCAACTGCACTTACAGTGACCGAGGTTCCCAGTCCTTCTTCTGGTACAGACAATA TTCTGGGAAAAGCCCTGAGTTGATAATGTTCATATACTCCAATGGTGACAAAGAAGATGGAA GGTTTACAGCACAGCTCAATAAAGCCAGCCAGTATGTTTCTCTGCTCATCAGAGACTCCCAG CCCAGTGATTCAGCCACCTACCTCTGTGCCGTGAACATGTTGGGGAGTGGAGGTAGCAACTA TAAACTGACATTTGGAAAAGGAACTCTCTTAACCGTGAATCCAAATATCCAGAATCCGGACC ccgcggtatatcaactgcgcgactcaaaatcatccgataagagtgtctgtttgtttactgac ttcgacagtcaaactaatgtctctcagagcaaagattccgatgtctacatcactgacaagtg cgttctggatatgcggagcatggatttaagtccaactccgccgtagcctggtccaacaagt cagactttgcctgtgcaaatgctttcaacaactcaattatccctgaggacactttctttcct tcaccggagtcctcatgcgatgttaaactggtcgaaaaatcttttgagacggatacgaacct caacttccaaaatttgagcgttattggctttaggattctgcttctcaaggttgcggggttca atctcctgatgacgttgcggctttggagcagctaa | TCR 60 Native full sequence with human constant (nt) |
| 140 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCATCAGTCGGACAGTCTCCTACGAGCAGTACTTCGGG CCGGGCACCAGGCTCACGGTCACAGAGGACCTGCGCAATGTGACCCCCCCTAAGGTGTCCCT | TCR 60 Native full sequence with mouse constant (nt) |

| SEQ ID NO | SEQUENCE | Description |
|---|---|---|
| | GTTTGAGCCCTCTAAGGCCGAGATCGCCAACAAGCAGAAGGCCACCCTGGTGTGCCTGGCCA<br>GAGGCTTCTTCCCTGATCACGTGGAGCTGAGCTGGTGGGTGAATGGCAAGGAGGTGCACTCC<br>GGCGTGTGCACCGACCCACAGGCCTACAAGGAGTCCAACTACTCTTATTGTCTGTCCTCTAG<br>GCTGCGCGTGAGCGCCACATTCTGGCACAACCCTCGGAATCACTTCAGATGCCAGGTGCAGT<br>TCACGGCCTGAGCGAGGAGGATAAGTGGCCAGAGGGCTCCCCAAAGCCCGTGACCCAGAAT<br>ATCTCTGCCGAGGCATGGGGCAGGGCCGACTGTGGAATCACCTCCGCCTCTTATCAGCAGGG<br>CGTGCTGTCCGCCACAATCCTGTACGAGATCCTGCTGGGCAAGGCCACCCTGTATGCCGTGC<br>TGGTGTCCACACTGGTGGTCATGGCCATGGTGAAGCGCAAGAACAGCtaaggctccggagca<br>accaatttcagcctgctgaagcaggccggcgatgtggaggagaatcctggcccaATGATGAA<br>ATCCTTGAGAGTTTTACTAGTGATCCTGTGGCTTCAGTTGAGCTGGGTTTGGAGCCAACAGA<br>AGGAGGTGGAGCAGAATTCTGGACCCCTCAGTGTTCCAGAGGGAGCCATTGCCTCTCTCAAC<br>TGCACTTACAGTGACCGAGGTTCCCAGTCCTTCTTCTGGTACAGACAATATTCTGGGAAAAG<br>CCCTGAGTTGATAATGTTCATATACTCCAATGGTGACAAAGAAGATGGAAGGTTTACAGCAC<br>AGCTCAATAAAGCCAGCCAGTATGTTTCTCTGCTCATCAGAGACTCCCAGCCCAGTGATTCA<br>GCCACCTACCTCTGTGCCGTGAACATGTTGGGGAGTGGAGGTAGCAACTATAAACTGACATT<br>TGGAAAAGGAACTCTCTTAACCGTGAATCCAAATATCCAGAATCCGGAGCCTGCCGTGTACC<br>AGCTGAAGGACCCACGGAGCCAGGATAGCACCCTGTGCCTGTTCACCGACTTTGATTCTCAG<br>ATCAACGTGCCCAAGACCATGGAGAGCGGCACCTTCATCACAGACAAGTGCGTGCTGGATAT<br>GAAGGCCATGGACAGCAAGTCCAACGGCGCCATCGCCTGGTCCAATCAGACATCTTTCACCT<br>GCCAGGATATCTTTAAGGAGACAAATGCCACCTATCCTTCCTCTGACGTGCCATGTGATGCC<br>ACCCTGACAGAGAAGAGCTTCGAGACCGACATGAACCTGAATTTTCAGAATCTGCTCGTGAT<br>TGTCCTGAGAATCCTGCTGCTGAAGGTGGCCGGCTTTAACCTGCTGATGACCCTGAGGCTGT<br>GGAGCTCCTGA | |
| 141 | MDTWLVCWAIFSLLKAGLTEPEVTQTPSHQVTQMGQEVILRCVPISNHLYFYWYRQILGQKV<br>EFLVSFYNNEISEKSEIFDDQFSVERPDGSNFTLKIRSTKLEDSAMYFCAISRTVSYEQYFG<br>PGTRLTVTEDLNKVFPPEVAVFEPSEAEISHTQKATLVCLATGFFPDHVELSWWVNGKEVHS<br>GVCTDPQPLKEQPALNDSRYCLSSRLRVSATFWQNPRNHFRCQVQFYGLSENDEWTQDRAKP<br>VTQIVSAEAWGRADCGFTSVSYQQGVLSATILYEILLGKATLYAVLVSALVLMAMVKRKDFG<br>SGATNFSLLKQAGDVEENPGPMMKSLRVLLVILWLQLSWVWSQQKEVEQNSGPLSVPEGAIA<br>SLNCTYSDRGSQSFFWYRQYSGKSPELIMFIYSNGDKEDGRFTAQLNKASQYVSLLIRDSQP<br>SDSATYLCAVNMLGSGGSNYKLTFGKGTLLTVNPNIQNPDPAVYQLRDSKSSDKSVCLFTDF<br>DSQTNVSQSKDSDVYITDKCVLDMRSMDPKSNAVAWSNKSDFACANAFNNSIIPEDTFFPS<br>PESSCDVKLVEKSFETDTNLNFQNLSVIGFRILLLKVAGFNLLMTLRLWSS | TCR 60 Full sequence with human constant (aa) |
| 142 | MDTWLVCWAIFSLLKAGLTEPEVTQTPSHQVTQMGQEVILRCVPISNHLYFYWYRQILGQKV<br>EFLVSFYNNEISEKSEIFDDQFSVERPDGSNFTLKIRSTKLEDSAMYFCAISRTVSYEQYFG<br>PGTRLTVTEDLRNVTPPKVSLFEPSKAEIANKQKATLVCLARGFFPDHVELSWWVNGKEVHS<br>GVCTDPQAYKESNYSYCLSSRLRVSATFWHNPRNHFRCQVVQFHGLSEEDKWPEGSPKPVTQN<br>ISAEAWGRADCGITSASYQQGVLSATILYEILLGKATLYAVLVSTLVVMAMVKRKNSGSAT<br>NFSLLKQAGDVEENPGPMMKSLRVLLVILWLQLSWVWSQQKEVEQNSGPLSVPEGAIASLNC<br>TYSDRGSQSFFWYRQYSGKSPELIMFIYSNGDKEDGRFTAQLNKASQYVSLLIRDSQPSDSA<br>TYLCAVNMLGSGGSNYKLTFGKGTLLTVNPNIQNPEPAVYQLKDPRSQDSTLCLFTDFDSQI<br>NVPKTMESGTFITDKCVLDMKAMDSKSNGAIAWSNQTSFTCQDIFKETNATYPSSDVPCDAT<br>LTEKSFETDMNLNFQNLLVIVLRILLLLKVAGFNLLMTLRLWSS | TCR 60 Full sequence with mouse constant (aa) |
| 143 | ATGATGAAATCCTTGAGAGTTTTACTAGTGATCCTGTGGCTTCAGTTGAGCTGGGTTTGGAG<br>CCAACAGAAGGAGGTGGAGCAGAATTCTGGACCCCTCAGTGTTCCAGAGGGAGCCATTGCCT<br>CTCTCAACTGCACTTACAGTGACCGAGGTTCCCAGTCCTTCTTCTGGTACAGACAATATTCT<br>GGGAAAAGCCCTGAGTTGATAATGTTCATATACTCCAATGGTGACAAAGAAGATGGAAGGTT<br>TACAGCACAGCTCAATAAAGCCAGCCAGTATGTTTCTCTGCTCATCAGAGACTCCCAGCCCA<br>GTGATTCAGCCACCTACCTCTGTGCCGTGAACATAGAGAATAACAATGCCAGACTCATGTTT<br>GGAGATGGAACTCAGCTGGTGGTGAAGCCCAATATCCAGAATCCGGACCccgcggtatatca<br>actgcgcgactcaaaatcatccgataagagtgtctgtttgtttactgacttcgacagtcaaa<br>ctaatgctctctcagagcaaagattccgatgtctacatcactgacaagtgcgttctggatatg<br>cggagcatggattttaagtccaactccgccgtagcctggtccaacaagtcagactttgcctg<br>tgcaaatgctttcaacaactcaattatccctgaggacacttctttccttcaccggagtcct<br>catgcgatgttaaactggtcgaaaaatcttttgagacggatacgaacctcaacttccaaaat<br>ttgagcgttattggctttaggattctgcttctcaaggttgcggggttcaatctcctgatgac<br>gttgcggctttggagcagctaa | TCR 61 Alpha Native with Codon Optimized Human Constant (nt) |
| 144 | ATGATGAAATCCTTGAGAGTTTTACTAGTGATCCTGTGGCTTCAGTTGAGCTGGGTTTGGAG<br>CCAACAGAAGGAGGTGGAGCAGAATTCTGGACCCCTCAGTGTTCCAGAGGGAGCCATTGCCT<br>CTCTCAACTGCACTTACAGTGACCGAGGTTCCCAGTCCTTCTTCTGGTACAGACAATATTCT<br>GGGAAAAGCCCTGAGTTGATAATGTTCATATACTCCAATGGTGACAAAGAAGATGGAAGGTT<br>TACAGCACAGCTCAATAAAGCCAGCCAGTATGTTTCTCTGCTCATCAGAGACTCCCAGCCCA<br>GTGATTCAGCCACCTACCTCTGTGCCGTGAACATAGAGAATAACAATGCCAGACTCATGTTT<br>GGAGATGGAACTCAGCTGGTGGTGAAGCCCAATATCCAGAATCCGGAGCCTGCCGTGTACCA<br>GCTGAAGGACCCACGGAGCCAGGATAGCACCCTGTGCCTGTTCACCGACTTTGATTCTCAGA<br>TCAACGTGCCCAAGACCATGGAGAGCGGCACCTTCATCACAGACAAGTGCGTGCTGGATATG<br>AAGGCCATGGACAGCAAGTCCAACGGCGCCATCGCCTGGTCCAATCAGACATCTTTCACCTG<br>CCAGGATATCTTTAAGGAGACAAATGCCACCTATCCTTCCTCTGACGTGCCATGTGATGCCA<br>CCCTGACAGAGAAGAGCTTCGAGACCGACATGAACCTGAATTTTCAGAATCTGCTCGTGATT | TCR 61 Alpha Native with Codon Optimized Mouse Constant (nt) |

SEQUENCE TABLE

| SEQ ID NO | SEQUENCE | Description |
|---|---|---|
| | GTCCTGAGAATCCTGCTGCTGAAGGTGGCCGGCTTTAACCTGCTGATGACCCTGAGGCTGTG<br>GAGCTCCTGA | |
| 145 | QKEVEQNSGPLSVPEGAIASLNCTYSDRGSQSFFWYRQYSGKSPELIMFIYSNGDKEDGRFT<br>AQLNKASQYVSLLIRDSQPSDSATYLCAVNIENNNARLMFGDGTQLVVKPNIQNPDPAVYQL<br>RDSKSSDKSVCLFTDFDSQTNVSQSKDSDVYITDKCVLDMRSMDFKSNSAVAWSNKSDFACA<br>NAFNNSIIPEDTFFPSPESSCDVKLVEKSFETDTNLNFQNLSVIGFRILLLKVAGFNLLMTL<br>RLWSS | TCR 61 Alpha with Codon Optimized Human Constant (aa) |
| 146 | QKEVEQNSGPLSVPEGAIASLNCTYSDRGSQSFFWYRQYSGKSPELIMFIYSNGDKEDGRFT<br>AQLNKASQYVSLLIRDSQPSDSATYLCAVNIENNNARLMFGDGTQLVVKPNIQNPEPAVYQL<br>KDPRSQDSTLCLFTDFDSQINVPKTMESGTFITDKCVLDMKAMDSKSNGAIAWSNQTSFTCQ<br>DIFKETNATYPSSDVPCDATLTEKSFETDMNLNFQNLLVIVLRILLLKVAGFNLLMTLRLWS<br>S | TCR 61 Alpha with Codon Optimized Mouse Constant (aa) |
| 147 | MMKSLRVLLVILWLQLSWVWSQQKEVEQNSGPLSVPEGAIASLNCTYSDRGSQSFFWYRQYS<br>GKSPELIMFIYSNGDKEDGRFTAQLNKASQYVSLLIRDSQPSDSATYLCAVNIENNNARLMF<br>GDGTQLVVKPNIQNPDPAVYQLRDSKSSDKSVCLFTDFDSQTNVSQSKDSDVYITDKCVLDM<br>RSMDFKSNSAVAWSNKSDFACANAFNNSIIPEDTFFPSPESSCDVKLVEKSFETDTNLNFQN<br>LSVIGFRILLLKVAGFNLLMTLRLWSS | TCR 61 Alpha with Codon Optimized Human Constant and signal peptide (aa) |
| 148 | MMKSLRVLLVILWLQLSWVWSQQKEVEQNSGPLSVPEGAIASLNCTYSDRGSQSFFWYRQYS<br>GKSPELIMFIYSNGDKEDGRFTAQLNKASQYVSLLIRDSQPSDSATYLCAVNIENNNARLMF<br>GDGTQLVVKPNIQNPEPAVYQLKDPRSQDSTLCLFTDFDSQINVPKTMESGTFITDKCVLDM<br>KAMDSKSNGAIAWSNQTSFTCQDIFKETNATYPSSDVPCDATLTEKSFETDMNLNFQNLLVI<br>VLRILLLKVAGFNLLMTLRLWSS | TCR 61 Alpha with Codon Optimized Mouse Constant and signal peptide (aa) |
| 149 | QKEVEQNSGPLSVPEGAIASLNCTYSDRGSQSFFWYRQYSGKSPELIMFIYSNGDKEDGRFT<br>AQLNKASQYVSLLIRDSQPSDSATYLCAVNIENNNARLMFGDGTQLVVKP | TCR 61 Alpha variable region (aa) |
| 150 | AVNIENNNARLM | TCR 61 Alpha CDR3 (aa) |
| 151 | ATGGATACCTGGCTCGTATGCTGGGCAATTTTTAGTCTCTTGAAAGCAGGACTCACAGAACC<br>TGAAGTCACCCAGACTCCCAGCCATCAGGTCACACAGATGGGACAGGAAGTGATCTTGCGCT<br>GTGTCCCCATCTCTAATCACTTATACTTCTATTGGTACAGACAAATCTTGGGGCAGAAAGTC<br>GAGTTTCTGGTTTCCTTTTATAATAATGAAATCTCAGAGAAGTCTGAAATATTCGATGATCA<br>ATTCTCAGTTGAAAGGCCTGATGGATCAAATTTCACTCTGAAGATCCGGTCCACAAAGCTGG<br>AGGACTCAGCCATGTACTTCTGTGCCAGCACCAAACGTTTTAGCTACGAGCAGTACTTCGGG<br>CCGGGCACCAGGCTCACGGTCACAgaggacctgaataaggtgttcccccctgaggtggccgt<br>gtttgagccaagcgaggccgagatctcccacacccagaaggccaccctggtgtgcctggcaa<br>ccggcttctttcccgatcacgtggagctgtcctggtgggtgaacggcaaggaggtgcactct<br>ggcgtgtgcacagacccacagccctgaaggagcagcctgcctgaatgattcccgctattg<br>tctgtcctctcggctgagagtgtctgccaccttttggcagaacccacggaatcacttcagat<br>gccaggtgcagttttacggcctgtctgagaacgacgagtggacccaggatcgggccaagcct<br>gtgacacagatcgtgagcgcggaagcatggggcagagccgactgtggcttcaccagcgtgtc<br>ctatcagcagggcgtgctgtccgccaccatcctgtacgagatcctgctgggcaaggccacac<br>tgtatgccgtgctggtgtctgccctggtgctgatggccatggtgaagagaaaagacttctaa | TCR 61 Beta Native with Codon Optimized Human Constant (nt) |
| 152 | ATGGATACCTGGCTCGTATGCTGGGCAATTTTTAGTCTCTTGAAAGCAGGACTCACAGAACC<br>TGAAGTCACCCAGACTCCCAGCCATCAGGTCACACAGATGGGACAGGAAGTGATCTTGCGCT<br>GTGTCCCCATCTCTAATCACTTATACTTCTATTGGTACAGACAAATCTTGGGGCAGAAAGTC<br>GAGTTTCTGGTTTCCTTTTATAATAATGAAATCTCAGAGAAGTCTGAAATATTCGATGATCA<br>ATTCTCAGTTGAAAGGCCTGATGGATCAAATTTCACTCTGAAGATCCGGTCCACAAAGCTGG<br>AGGACTCAGCCATGTACTTCTGTGCCAGCACCAAACGTTTTAGCTACGAGCAGTACTTCGGG<br>CCGGGCACCAGGCTCACGGTCACAGAGGACCTGCGCAATGTGATCCCCCCTAAGGTGTCCCT<br>GTTTGAGCCCTCTAAGGCCGAGATCGCCAACAAGCAGAAGGCCACCCTGGTGTGCCTGGCCA<br>GAGGCTTCTTCCCTGATCACGTGGAGCTGAGCTGGTGGGTGAATGGCAAGGAGGTGCACTCC<br>GGCGTGTGCACCGACCCACAGGCCTACAAGGAGTCCAACTACTCTTATTGTCTGTCCTCTAG<br>GCTGCGCGTGAGCGCCACATTCTGGCACAACCCTCGGAATCACTTCAGATGCCAGGTGCAGT<br>TTCACGGCCTGAGCGAGGAGGATAAGTGGCCAGAGGGCTCCCCAAAGCCCGTGACCCAGAAT<br>ATCTCTGCCGAGGCATGGGCCAGGGCCGACTGTGGAATCACCTCCGCCTCTTATCAGCAGGG<br>CGTGCTGTCCGCCACAATCCTGTACGAGATCCTGCTGGGCAAGGCCACCCTGTATGCCGTGC<br>TGGTGTCCACACTGGTGGTCATGGCCATGGTGAAGCGCAAGAACAGCtaa | TCR 61 Beta Native with Codon Optimized Mouse Constant (nt) |

SEQUENCE TABLE

| SEQ ID NO | SEQUENCE | Description |
|---|---|---|
| 153 | EPEVTQTPSHQVTQMGQEVILRCVPISNHLYFYWYRQILGQKVEFLVSFYNNEISEKSEIFD DQFSVERPDGSNFTLKIRSTKLEDSAMYFCASTKRFSYEQYFGPGTRLTVTEDLNKVFPPEV AVFEPSEAEISHTQKATLVCLATGFFPDHVELSWWVNGKEVHSGVCTDPQPLKEQPALNDSR YCLSSRLRVSATFWQNPRNHFRCQVQFYGLSENDEWTQDRAKPVTQIVSAEAWGRADCGFTS VSYQQGVLSATILYEILLGKATLYAVLVSALVLMAMVKRKDF | TCR 61 Beta with Codon Optimized Human Constant (aa) |
| 154 | EPEVTQTPSHQVTQMGQEVILRCVPISNHLYFYWYRQILGQKVEFLVSFYNNEISEKSEIFD DQFSVERPDGSNFTLKIRSTKLEDSAMYFCASTKRFSYEQYFGPGTRLTVTEDLRNVTPPKV SLFEPSKAEIANKQKATLVCLARGFFPDHVELSWWVNGKEVHSGVCTDPQAYKESNYSYCLS SRLRVSATFWHNPRNHFRCQVQFHGLSEEDKWPEGSPKPVTQNISAEAWGRADCGITSASYQ QGVLSATILYEILLGKATLYAVLVSTLVVMAMVKRKNS | TCR 61 Beta with Codon Optimized Mouse Constant (aa) |
| 155 | MDTWLVCWAIFSLLKAGLTEPEVTQTPSHQVTQMGQEVILRCVPISNHLYFYWYRQILGQKV EFLVSFYNNEISEKSEIFDDQFSVERPDGSNFTLKIRSTKLEDSAMYFCASTKRFSYEQYFG PGTRLTVTEDLNKVFPPEVAVFEPSEAEISHTQKATLVCLATGFFPDHVELSWWVNGKEVHS GVCTDPQPLKEQPALNDSRYCLSSRLRVSATFWQNPRNHFRCQVQFYGLSENDEWTQDRAKP VTQIVSAEAWGRADCGFTSVSYQQGVLSATILYEILLGKATLYAVLVSALVLMAMVKRKDF | TCR 61 Beta with Codon Optimized Human Constant and signal peptide (aa) |
| 156 | MDTWLVCWAIFSLLKAGLTEPEVTQTPSHQVTQMGQEVILRCVPISNHLYFYWYRQILGQKV EFLVSFYNNEISEKSEIFDDQFSVERPDGSNFTLKIRSTKLEDSAMYFCASTKRFSYEQYFG PGTRLTVTEDLRNVTPPKVSLFEPSKAEIANKQKATLVCLARGFFPDHVELSWWVNGKEVHS GVCTDPQAYKESNYSYCLSSRLRVSATFWHNPRNHFRCQVQFHGLSEEDKWPEGSPKPVTQN ISAEAWGRADCGITSASYQQGVLSATILYEILLGKATLYAVLVSTLVVMAMVKRKNS | TCR 61 Beta with Codon Optimized Mouse Constant and signal peptide (aa) |
| 157 | EPEVTQTPSHQVTQMGQEVILRCVPISNHLYFYWYRQILGQKVEFLVSFYNNEISEKSEIFD DQFSVERPDGSNFTLKIRSTKLEDSAMYFCASTKRFSYEQYFGPGTRLTVT | TCR 61 Beta variable region (aa) |
| 158 | ASTKRFSYEQY | TCR 61 Beta CDR3 (aa) |
| 159 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCAGCACCAAACGTTTTAGCTACGAGCAGTACTTCGGG CCGGGCACCAGGCTCACGGTCACAgaggacctgaataaggtgttcccccctgaggtggccgt gtttgagccaagcgaggccgagatctcccacacccagaaggccaccctggtgtgcctggcaa ccggcttctttcccgatcacgtggagctgtcctggtgggtgaacggcaaggaggtgcactct ggcgtgtgcacagacccacagcccctgaaggagcagcctgcctgaatgattcccgctattg tctgtcctctcggctgagagtgtctgccaccttttggcagaacccacggaatcacttcagat gccaggtgcagttttacggcctgtctgagaacgacgagtggacccaggatcgggccaagcct gtgacacagatcgtgagcgcggaagcatggggcagagccgactgtggcttcaccagcgtgtc ctatcagcagggcgtgctgtccgccaccatcctgtacgagatcctgctgggcaaggccacac tgtatgccgtgctggtgtctgccctggtgctgatggccatggtgaagagaaaagacttctaa ggctccggagcaaccaatttcagcctgctgaagcaggccggcgatgtggaggagaatcctgg cccaATGATGAAATCCTTGAGAGTTTTACTAGTGATCCTGTGCCTTCAGTTGAGCTGGGTTT GGAGCCAACAGAAGGAGGTGGAGCAGAATTCTGGACCCCTCAGTGTTCCAGAGGGAGCCATT GCCTCTCTCAACTGCACTTACAGTGACCGAGGTTCCCAGTCCTTCTTCTGGTACAGACAATA TTCTGGGAAAAGCCCTGAGTTGATAATGTTCATATACTCCAATGGTGACAAAGAAGATGGAA GGTTTACAGCACAGCTCAATAAAGCCAGCCAGTATGTTTCTCTGCTCATCAGAGACTCCCAG CCCAGTGATTCAGCCACCTACCTCTGTGCCGTGAACATAGAGAATAACAATGCCAGACTCAT GTTTGGAGATGGAACTCAGCTGGTGGTGAAGCCCAATATCCAGAATCCGGACCccgccggtat atcaactgcgcgactcaaaatcatccgataagagtgtctgtttgtttactgacttcgacagt caaactaatgtctctcagagcaaagattccgatgtctacatcactgacaagtgcgttctgga tatgcggagcatggattttaagtccaactccgcgcgtagcctggtccaacaagtcagactttg cctgtgcaaatgctttcaacaactcaattatccctgaggacactttctttccttcaccggag tcctcatgcgatgttaaactggtcgaaaaatcttttgagacggatacgaacctcaacttcca aaatttgagcgttattggctttaggattctgcttctcaaggttgcggggttcaatctcctga tgacgttgcggctttggagcagctaa | TCR 61 Native full sequence with human constant (nt) |
| 160 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCAGCACCAAACGTTTTAGCTACGAGCAGTACTTCGGG CCGGGCACCAGGCTCACGGTCACAGAGGACCTGCGCAATGTGACCCCCCCTAAGGTGTCCCT | TCR 61 Native full sequence with mouse constant (nt) |

| SEQ ID NO | SEQUENCE | Description |
|---|---|---|
| | GTTTGAGCCCTCTAAGGCCGAGATCGCCAACAAGCAGAAGGCCACCCTGGTGTGCCTGGCCA<br>GAGGCTTCTTCCCTGATCACGTGGAGCTGAGCTGGTGGGTGAATGGCAAGGAGGTGCACTCC<br>GGCGTGTGCACCGACCCACAGGCCTACAAGGAGTCCAACTACTCTTATTGTCTGTCCTCTAG<br>GCTGCGCGTGAGCGCCACATTCTGGCACAACCCTCGGAATCACTTCAGATGCCAGGTGCAGT<br>TCACGGCCTGAGCGAGGAGGATAAGTGGCCAGAGGGCTCCCCAAAGCCCGTGACCCAGAAT<br>ATCTCTGCCGAGGCATGGGCAGGGCCGACTGTGGAATCACCTCCGCCTCTTATCAGCAGGG<br>CGTGCTGTCCGCCACAATCCTGTACGAGATCCTGCTGGGCAAGGCCACCCTGTATGCCGTGC<br>TGGTGTCCACACTGGTGGTCATGGCCATGGTGAAGCGCAAGAACAGCtaaggctccggagca<br>accaatttcagcctgctgaagcaggccggcgatgtggaggagaatcctggcccaATGATGAA<br>ATCCTTGAGAGTTTTACTAGTGATCCTGTGGCTTCAGTTGAGCTGGGTTTGGAGCCAACAGA<br>AGGAGGTGGAGCAGAATTCTGGACCCCTCAGTGTTCCAGAGGGAGCCATTGCCTCTCTCAAC<br>TGCACTTACAGTGACCGAGGTTCCCAGTCCTTCTTCTGGTACAGACAATATTCTGGGAAAAG<br>CCCTGAGTTGATAATGTTCATATACTCCAATGGTGACAAAGAAGATGGAAGGTTTACAGCAC<br>AGCTCAATAAAGCCAGCCAGTATGTTTCTCTGCTCATCAGAGACTCCCAGCCCAGTGATTCA<br>GCCACCTACCTCTGTGCCGTGAACATAGAGAATAACAATGCCAGACTCATGTTTGGAGATGG<br>AACTCAGCTGGTGGTGAAGCCCAATATCCAGAATCCGGAGCCTGCCGTGTACCAGCTGAAGG<br>ACCCACGGAGCCAGGATAGCACCCTGTGCCTGTTCACCGACTTTGATTCTCAGATCAACGTG<br>CCCAAGACCATGGAGAGCGGCACCTTCATCACAGACAAGTGCGTGCTGGATATGAAGGCCAT<br>GGACAGCAAGTCCAACGGCGCCATCGCCTGGTCCAATCAGACATCTTTCACCTGCCAGGATA<br>TCTTTAAGGAGACAAATGCCACCTATCCTTCCTCTGACGTGCCATGTGATGCCACCCTGACA<br>GAGAAGAGCTTCGAGACCGACATGAACCTGAATTTTCAGAATCTGCTCGTGATTGTCCTGAG<br>AATCCTGCTGCTGAAGGTGGCCGGCTTTAACCTGCTGATGACCCTGAGGCTGTGGAGCTCCT<br>GA | |
| 161 | MDTWLVCWAIFSLLKAGLTEPEVTQTPSHQVTQMGQEVILRCVPISNHLYFYWYRQILGQKV<br>EFLVSFYNNEISEKSEIFDDQFSVERPDGSNFTLKIRSTKLEDSAMYFCASTKRFSYEQYFG<br>PGTRLTVTEDLNKVFPPEVAVFEPSEAEISHTQKATLVCLATGFFPDHVELSWWVNGKEVHS<br>GVCTDPQPLKEQPALNDSRYCLSSRLRVSATFWQNPRNHFRCQVFYGLSENDEWTQDRAKP<br>VTQIVSAEAWGRADCGFTSVSYQQGVLSATILYEILLGKATLYAVLVSALVLMAMVKRKDFG<br>SGATNFSLLKQAGDVEENPGPMMKSLRVLLVILWLQLSWVWSQQKEVEQNSGPLSVPEGAIA<br>SLNCTYSDRGSQSFFWYRQYSGKSPELIMFIYSNGDKEDGRFTAQLNKASQYVSLLIRDSQP<br>SDSATYLCAVNIENNNARLMFGDGTQLVVKPNIQNPDPAVYQLRDSKSSDKSVCLFTDFDSQ<br>TNVSQSKDSDVYITDKCVLDMRSMDFKSNSAVAWSNKSDFACANAFNNSIIPEDTFFPSPES<br>SCDVKLVEKSFETDTNLNFQNLSVIGFRILLLKVAGFNLLMTLRLWSS | TCR 61 Full sequence with human constant (aa) |
| 162 | MDTWLVCWAIFSLLKAGLTEPEVTQTPSHQVTQMGQEVILRCVPISNHLYFYWYRQILGQKV<br>EFLVSFYNNEISEKSEIFDDQFSVERPDGSNFTLKIRSTKLEDSAMYFCASTKRFSYEQYFG<br>PGTRLTVTEDLRNVTPPKVSLFEPSKAEIANKQKATLVCLARGFFPDHVELSWWVNGKEVHS<br>GVCTDPQAYKESNYSYCLSSRLRVSATFWHNPRNHFRCQVQFHGLSEEDKWPEGSPKPVTQN<br>ISAEAWGRADCGITSASYQQGVLSATILYEILLGKATLYAVLVSTLVVMAMVKRKNSGSGAT<br>NFSLLKQAGDVEENPGPMMKSLRVLLVILWLQLSWVWSQQKEVEQNSGPLSVPEGAIASLNC<br>TYSDRGSQSFFWYRQYSGKSPELIMFIYSNGDKEDGRFTAQLNKASQYVSLLIRDSQPSDSA<br>TYLCAVNIENNNARLMFGDGTQLVVKPNIQNPEPAVYQLKDPRSQDSTLCLFTDFDSQINVP<br>KTMESGTFITDKCVLDMKAMDSKSNGAIAWSNQTSFTCQDIFKETNATYPSSDVPCDATLTE<br>KSFETDMNLNFQNLLVIVLRILLLKVAGFNLLMTLRLWSS | TCR 61 Full sequence with mouse constant (aa) |
| 163 | ATGACACGAGTTAGCTTGCTGTGGGCAGTCGTGGTCTCCACCTGTCTTGAATCCGGCATGGC<br>CCAGACAGTCACTCAGTCTCAACCAGAGATGTCTGTGCAGGAGGCAGAGACTGTGACCCTGA<br>GTTGCACATATGACACCAGTGAGAATAATTATTATTTGTTCTGGTACAAGCAGCCTCCCAGC<br>AGGCAGATGATTCTCGTTATTCGCCAAGAAGCTTATAAGCAACAGAATGCAACGGAGAATCG<br>TTTCTCTGTGAACTTCCAGAAAGCAGCCAAATCCTTCAGTCTCAAGATCTCAGACTCACAGC<br>TGGGGGACACTGCGATGTATTTCTGTGCTCTCTATACCTACAAATACATCTTTGGAACAGGC<br>ACCAGGCTGAAGGTTTTAGCAAATATCCAGAATCCGGACCCcgcggtatatcaactgcgcga<br>ctcaaaatcatccgataagagtgtctgtttgtttactgacttcgacagtcaaactaatgtct<br>ctcagagcaaagattccgatgtctacatcactgacaagtgcgttctggatatgcggagcatg<br>gatttttaagtccaactccgccgtagcctggtccaacaagtcagactttgcctgtgcaaatgc<br>tttcaacaactcaattatccctgaggacactttctttccttcaccggagtcctcatgcgatg<br>ttaaactggtcgaaaaatcttttgagacggatacgaacctcaacttccaaaatttgagcgtt<br>attggctttaggattctgcttctcaaggttgcggggttcaatctcctgatgacgttgcggct<br>ttggagcagctaa | TCR 62 Alpha Native with Codon Optimized Human Constant (nt) |
| 164 | ATGACACGAGTTAGCTTGCTGTGGGCAGTCGTGGTCTCCACCTGTCTTGAATCCGGCATGGC<br>CCAGACAGTCACTCAGTCTCAACCAGAGATGTCTGTGCAGGAGGCAGAGACTGTGACCCTGA<br>GTTGCACATATGACACCAGTGAGAATAATTATTATTTGTTCTGGTACAAGCAGCCTCCCAGC<br>AGGCAGATGATTCTCGTTATTCGCCAAGAAGCTTATAAGCAACAGAATGCAACGGAGAATCG<br>TTTCTCTGTGAACTTCCAGAAAGCAGCCAAATCCTTCAGTCTCAAGATCTCAGACTCACAGC<br>TGGGGGACACTGCGATGTATTTCTGTGCTCTCTATACCTACAAATACATCTTTGGAACAGGC<br>ACCAGGCTGAAGGTTTTAGCAAATATCCAGAATCCGGAGCCTGCCGTGTACCAGCTGAAGGA<br>CCCACGGAGCCAGGATAGCACCCTGTGCCTGTTCACCGACTTTGATTCTCAGATCAACGTGC<br>CCAAGACCATGGAGAGCGGCACCTTCATCACAGACAAGTGCGTGCTGGATATGAAGGCCATG<br>GACAGCAAGTCCAACGGCGCCATCGCCTGGTCCAATCAGACATCTTTCACCTGCCAGGATAT | TCR 62 Alpha Native with Codon Optimized Mouse Constant (nt) |

SEQUENCE TABLE

| SEQ ID NO | SEQUENCE | Description |
|---|---|---|
| | CTTTAAGGAGACAAATGCCACCTATCCTTCCTCTGACGTGCCATGTGATGCCACCCTGACAGAGAAGAGCTTCGAGACCGACATGAACCTGAATTTTCAGAATCTGCTCGTGATTGTCCTGAGAATCCTGCTGCTGAAGGTGGCCGGCTTTAACCTGCTGATGACCCTGAGGCTGTGGAGCTCCTGA | |
| 165 | AQTVTQSQPEMSVQEAETVTLSCTYDTSENNYYLFWYKQPPSRQMILVIRQEAYKQQNATENRFSVNFQKAAKSFSLKISDSQLGDTAMYFCALYTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS | TCR 62 Alpha with Codon Optimized Human Constant (aa) |
| 166 | AQTVTQSQPEMSVQEAETVTLSCTYDTSENNYYLFWYKQPPSRQMILVIRQEAYKQQNATENRFSVNFQKAAKSFSLKISDSQLGDTAMYFCALYTYKYIFGTGTRLKVLANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS | TCR 62 Alpha with Codon Optimized Mouse Constant (aa) |
| 167 | MTRVSLLWAVVVSTCLESGMAQTVTQSQPEMSVQEAETVTLSCTYDTSENNYYLFWYKQPPSRQMILVIRQEAYKQQNATENRFSVNFQKAAKSFSLKISDSQLGDTAMYFCALYTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS | TCR 62 Alpha with Codon Optimized Human Constant and signal peptide (aa) |
| 168 | MTRVSLLWAVVVSTCLESGMAQTVTQSQPEMSVQEAETVTLSCTYDTSENNYYLFWYKQPPSRQMILVIRQEAYKQQNATENRFSVNFQKAAKSFSLKISDSQLGDTAMYFCALYTYKYIFGTGTRLKVLANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS | TCR 62 Alpha with Codon Optimized Mouse Constant and signal peptide (aa) |
| 169 | AQTVTQSQPEMSVQEAETVTLSCTYDTSENNYYLFWYKQPPSRQMILVIRQEAYKQQNATENRFSVNFQKAAKSFSLKISDSQLGDTAMYFCALYTYKYIFGTGTRLKVLA | TCR 62 Alpha variable region (aa) |
| 170 | TSENNYY | TCR 62 Alpha CDR1 (aa) |
| 171 | QEAYKQQN | TCR 62 Alpha CDR2 (aa) |
| 172 | ALYTYKYI | TCR 62 Alpha CDR3 (aa) |
| 173 | MTRVSLLWAVVVSTCLESGM | TCR 62 Alpha Signal peptide (aa) |
| 174 | ATGGGCACCAGGCTCCTCTGCTGGGCGGCCCTCTGTCTCCTGGGAGCAGAACTCACAGAAGCTGGAGTTGCCCAGTCTCCCAGATATAAGATTATAGAGAAAAGGCAGAGTGTGGCTTTTTGGTGCAATCCTATATCTGGCCATGCTACCCTTTACTGGTACCAGCAGATCCTGGGACAGGGCCCAAAGCTTCTGATTCAGTTTCAGAATAACGGTGTAGTGGATGATTCACAGTTGCCTAAGGATCGATTTTCTGCAGAGAGGCTCAAAGGAGTAGACTCCACTCTCAAGATCCAgCCTGCAAAGCTTGAGGACTCGGCCGTGTATCTCTGTGCCAGCAGCTTAGATACCCGGGGCTCCTCCTACAATGAGCAGTTCTTCGGGCCAGGGACACGGCTCACCGTGCTAgaggacctgaataaggtgttccccctgaggtggccgtgtttgagccaagcgaggccgagatctcccacacccagaaggccaccctggtgtgcctggcaaccggcttcttttcccgatcacgtggagctgttcctggtgggtgaacggcaaggaggtgcactctggcgtgtgcagacccacagccctgaaggagcagcctgccctgaatgattcccgctattgtctgtcctctcggctgagagtgtctgccaccttttggcagaacccacggaatcacttcagatgccaggtcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa | TCR 62 Beta Native with Codon Optimized Human Constant (nt) |
| 175 | ATGGGCACCAGGCTCCTCTGCTGGGCGGCCCTCTGTCTCCTGGGAGCAGAACTCACAGAAGCTGGAGTTGCCCAGTCTCCCAGATATAAGATTATAGAGAAAAGGCAGAGTGTGGCTTTTTGGTGCAATCCTATATCTGGCCATGCTACCCTTTACTGGTACCAGCAGATCCTGGGACAGGGCCCAAAGCTTCTGATTCAGTTTCAGAATAACGGTGTAGTGGATGATTCACAGTTGCCTAAGGATCGATTTTCTGCAGAGAGGCTCAAAGGAGTAGACTCCACTCTCAAGATCCAgCCTGCAAAGCTTGAGGACTCGGCCGTGTATCTCTGTGCCAGCAGCTTAGATACCCGGGGCTCCTCCTACAATGAGCAGTTCTTCGGGCCAGGGACACGGCTCACCGTGCTAGAGGACCTGCGCAATGTGACCCCCCC | TCR 62 Beta Native with Codon Optimized Mouse Constant (nt) |

SEQUENCE TABLE

| SEQ ID NO | SEQUENCE | Description |
|---|---|---|
| | TAAGGTGTCCCTGTTTGAGCCCTCTAAGGCCGAGATCGCCAACAAGCAGAAGGCCACCCTGG<br>TGTGCCTGGCCAGAGGCTTCTTCCCTGATCACGTGGAGCTGAGCTGGTGGGTGAATGGCAAG<br>GAGGTGCACTCCGGCGTGTGCACCGACCCACAGGCCTACAAGGAGTCCAACTACTCTTATTG<br>TCTGTCCTCTAGGCTGCGCGTGAGCGCCACATTCTGGCACAACCCTCGGAATCACTTCAGAT<br>GCCAGGTGCAGTTTCACGGCCTGAGCGAGGAGGATAAGTGGCCAGAGGGCTCCCCAAAGCCC<br>GTGACCCAGAATATCTCTGCCGAGGCATGGGGCAGGGCCGACTGTGGAATCACCTCCGCCTC<br>TTATCAGCAGGGCGTGCTGTCCGCCACAATCCTGTACGAGATCCTGCTGGGCAAGGCCACCC<br>TGTATGCCGTGCTGGTGTCCACACTGGTGGTCATGGCCATGGTGAAGCGCAAGAACAGCtaa | |
| 176 | EAGVAQSPRYKIIEKRQSVAFWCNpISGHATLYWYQQILGQGPKLLIQFQNNGVVDDSQLPK<br>DRFSAERLKGVDSTLKIQPAKLEDSAVYLCASSLDTRGSSYNEQFFGPGTRLTVLEDLNKVF<br>PPEVAVFEPSEAEISHTQKATLVCLATGFFPDHVELSWWVNGKEVHSGVCTDPQPLKEQPAL<br>NDSRYCLSSRLRVSATFWQNPRNHFRCQVFYGLSENDEWTQDRAKPVTQIVSAEAWGRADC<br>GFTSVSYQQGVLSATILYEILLGKATLYAVLVSALVLMAMVKRKDF | TCR 62 Beta with Codon Optimized Human Constant (aa) |
| 177 | EAGVAQSPRYKIIEKRQSVAFWCNPISGHATLYWYQQILGQGPKLLIQFQNNGVVDDSQLPK<br>DRFSAERLKGVDSTLKIQPAKLEDSAVYLCASSLDTRGSSYNEQFFGPGTRLTVLEDLRNVT<br>PPKVSLFEPSKAEIANKQKATLVCLARGFFPDHVELSWWVNGKEVHSGVCTDPQAYKESNYS<br>YCLSSRLRVSATFWHNPRNHFRCQVQFHGLSEEDKWPEGSPKPVTQNISAEAWGRADCGITS<br>ASYQQGVLSATILYEILLGKATLYAVLVSTLVVMAMVKRKNS | TCR 62 Beta with Codon Optimized Mouse Constant (aa) |
| 178 | MGTRLLCWAALCLLGAELTEAGVAQSPRYKIIEKRQSVAFWCNPISGHATLYWYQQILGQGP<br>KLLIQFQNNGVVDDSQLPKDRFSAERLKGVDSTLKIQPAKLEDSAVYLCASSLDTRGSSYNE<br>QFFGPGTRLTVLEDLNKVFPPEVAVFEPSEAEISHTQKATLVCLATGFFPDHVELSWWVNGK<br>EVHSGVCTDPQPLKEQPALNDSRYCLSSRLRVSATFWQNPRNHFRCQVQFYGLSENDEWTQD<br>RAKPVTQIVSAEAWGRADCGFTSVSYQQGVLSATILYEILLGKATLYAVLVSALVLMAMVKR<br>KDF | TCR 62 Beta with Codon Optimized Human Constant and signal peptide (aa) |
| 179 | MGTRLLCWAALCLLGAELTEAGVAQSPRYKIIEKRQSVAFWCNPISGHATLYWYQQILGQGP<br>KLLIQFQNNGVVDDSQLPKDRFSAERLKGVDSTLKIQPAKLEDSAVYLCASSLDTRGSSYNE<br>QFFGPGTRLTVLEDLRNVTPPKVSLFEPSKAEIANKQKATLVCLARGFFPDHVELSWWVNGK<br>EVHSGVCTDPQAYKESNYSYCLSSRLRVSATFWHNPRNHFRCQVQFHGLSEEDKWPEGSPKP<br>VTQNISAEAWGRADCGITSASYQQGVLSATILYEILLGKATLYAVLVSTLVVMAMVKRKNS | TCR 62 Beta with Codon Optimized Mouse Constant and signal peptide (aa) |
| 180 | EAGVAQSPRYKIIEKRQSVAFWCNpISGHATLYWYQQILGQGPKLLIQFQNNGVVDDSQLPK<br>DRFSAERLKGVDSTLKIQPAKLEDSAVYLCASSLDTRGSSYNEQFFGPGTRLTVL | TCR 62 Beta variable region (aa) |
| 181 | SGHAT | TCR 62 Beta CDR1 (aa) |
| 182 | FQNNGV | TCR 62 Beta CDR2 (aa) |
| 183 | ASSLDTRGSSYNEQF | TCR 62 Beta CDR3 (aa) |
| 184 | MGTRLLCWAALCLLGAELT | TCR 62 Beta signal peptide (aa) |
| 185 | ATGGGCACCAGGCTCCTCTGCTGGGCGGCCCTCTGTCTCCTGGGAGCAGAACTCACAGAAGC<br>TGGAGTTGCCCAGTCTCCCAGATATAAGATTATAGAGAAAAGGCAGAGTGTGGCTTTTTGGT<br>GCAATCCTATATCTGGCCATGCTACCCTTTACTGGTACCAGCAGATCCTGGGACAGGGCCCA<br>AAGCTTCTGATTCAGTTTCAGAATAACGGTGTAGTGGATGATTCACAGTTGCCTAAGGATCG<br>ATTTTCTGCAGAGAGGCTCAAAGGAGTAGACTCCACTCTCAAGATCCAgCCTGCAAAGCTTG<br>AGGACTCGGCCGTGTATCTCTGTGCCAGCAGCTTAGATACCCGGGGCTCCTCCTACAATGAG<br>CAGTTCTTCGGGCCAGGGACACGGCTCACCGTGCTAgaggacctgaataaggtgttccccc<br>tgaggtggccgtgtttgagccaagcgaggccgagatctcccacacccagaaggccaccctgg<br>tgtgcctggcaaccggcttcttcccgatcacgtggagctgtcctggtgggtgaacggcaag<br>gaggtgcactctggcgtgtgcacagacccacagccctgaaagaagcaccagttggaagaga<br>ttcccgctattgtctgtcctctcggctgagagtgtctgccacctttggcagaacccacgga<br>atcacttcagatgccaggtgcagttttacggcctgtctgagaacgacgagtggacccaggat<br>cgggccaagcctgtgacacagatcgtgagcgcggaagcatggggcagagccgactgtggctt<br>caccagcgtgtcctatcagcagggcgtgctgtccgccaccatcctgtacgagatcctgctgg<br>gcaaggccacactgtatgccgtgctggtgtctgccctggtgctgatggccatggtgaagaa<br>aaagacttctaaggctccggagcaaccaatttcagcctgctgaagcaggccggcgatgtgga<br>ggagaatcctgggccaATGACACGAGTTAGCTTGCTGTGGGCAGTCGTGGTCTCCACCTGTC<br>TTGAATCCGGCATGGCCCAGACAGTCACTCAGTCTCAACCAGAGATGTCTGTGCAGGAGGCA<br>GAGACTGTGACCCTGAGTTGCACATATGACACCAGTGAGAATAATTATTATTTGTTCTGGTA<br>CAAGCAGCCTCCCAGCAGGCAGATGATTCTCGTTATTCGCCAAGAAGCTTATAAGCAACAGA | TCR 62 Native full sequence with human constant (nt) |

SEQUENCE TABLE

| SEQ ID NO | SEQUENCE | Description |
|---|---|---|
| | ATGCAACGGAGAATCGTTTCTCTGTGAACTTCCAGAAAGCAGCCAAATCCTTCAGTCTCAAG<br>ATCTCAGACTCACAGCTGGGGGACACTGCGATGTATTTCTGTGCTCTCTATACCTACAAATA<br>CATCTTTGGAACAGGCACCAGGCTGAAGGTTTTAGCAAATATCCAGAATCCGGACCccgcgg<br>tatatcaactgcgcgactcaaaatcatccgataagagtgtctgtttgtttactgacttcgac<br>agtcaaactaatgtctctcagagcaaagattccgatgtctacatcactgacaagtgcgttct<br>ggatatgcggagcatggattttaagtccaactccgccgtagcctggtccaacaagtcagact<br>ttgcctgtgcaaatgctttcaacaactcaattatccctgaggacactttctttccttcaccg<br>gagtcctcatgcgatgttaaactggtcgaaaaatcttttgagacggatacgaacctcaactt<br>ccaaaatttgagcgttattggctttaggattctgcttctcaaggttgcggggttcaatctcc<br>tgatgacgttgcggctttggagcagctaa | |
| 186 | ATGGGCACCAGGCTCCTCTGCTGGGCGGCCCTCTGTCTCCTGGGAGCAGAACTCACAGAAGC<br>TGGAGTTGCCCAGTCTCCCAGATATAAGATTATAGAGAAAAGGCAGAGTGTGGCTTTTTGGT<br>GCAATCCTATATCTGGCCATGCTACCCTTTACTGGTACCAGCAGATCCTGGGACAGGGCCCA<br>AAGCTTCTGATTCAGTTTCAGAATAACGGTGTAGTGGATGATTCACAGTTGCCTAAGGATCG<br>ATTTTCTGCAGAGAGGCTCAAAGGAGTAGACTCCACTCTCAAGATCCAgCCTGCAAAGCTTG<br>AGGACTCGGCCGTGTATCTCTGTGCCAGCAGCTTAGATACCCGGGGCTCCTCCTACAATGAG<br>CAGTTCTTCGGGCCAGGGACACGGCTCACCGTGCTAGAGGACCTGCGCAATGTGACCCCCCC<br>TAAGGTGTCCCTGTTTGAGCCCTCTAAGGCCGAGATCGCCAACAAGCAGAAGGCCACCCTGG<br>TGTGCCTGGCCAGAGGCTTCTTCCCTGATCACGTGGAGCTGTCGTGGTGGGTGAATGGCAAG<br>GAGGTGCACTCCGGCGTGTGCACCGACCCACAGGCCTACAAGGAGTCCAACTACTCTTATTG<br>TCTGTCCTCTAGGCTGCGCGTGAGCGCCACATTCTGGCACAACCCTCGGAATCACTTCAGAT<br>GCCAGGTGCAGTTTCACGGCCTGAGCGAGGAGGATAAGTGGCCAGAGGGCTCCCCAAAGCCC<br>GTGACCCAGAATATCTCTGCCGAGGCATGGGGCAGGGCCGACTGTGGAATCACCTCCGCCTC<br>TTATCAGCAGGGCGTGCTGTCCGCCACAATCCTGTACGAGATCCTGCTGGGCAAGGCCACCC<br>TGTATGCCGTGCTGGTGTCCACACTGGTGGTCATGGCCATGGTGAAGCGCAAGAACAGCtaa<br>ggctccggagcaaccaatttcagcctgctgaagcaggccggcgatgtggaggagaatcctgg<br>cccaATGACACGAGTTAGCTTGCTGTGGGCAGTCGTGGTCTCCAACTGTCTTGAATCCGGCA<br>TGGCCCAGACAGTCACTCAGTCTCAACCAGAGATGTCTGTCAGGAGGCAGAGACTGTGACC<br>CTGAGTTGCACATATGACACCAGTGAGAATAATTATTATTTGTTCTGGTACAAGCAGCCTCC<br>CAGCAGGCAGATGATTCTCGTTATTCGCCAAGAAGCTTATAAGCAACAGAATGCAACGGAGA<br>ATCGTTTCTCTGTGAACTTCCAGAAAGCAGCCAAATCCTTCAGTCTCAAGATCTCAGACTCA<br>CAGCTGGGGGACACTGCGATGTATTTCTGTGCTCTCTATACCTACAAATACATCTTTGGAAC<br>AGGCACCAGGCTGAAGGTTTTAGCAAATATCCAGAATCCGGAGCCTGCCGTGTACCAGCTGA<br>AGGACCCACGGAGCCAGGATAGCACCCTGTGCCTGTTCACCGACTTTGATTCTCAGATCAAC<br>GTGCCCAAGACCATGGAGAGCGGCACCTTCATCACAGACAAGTGCGTGCTGGATATGAAGGC<br>CATGGACAGCAAGTCCAACGGCGCCATCGCCTGGTCCAATCAGACATCTTTCACCTGCCAGG<br>ATATCTTTAAGGAGACAAATGCCACCTATCCTTCCTCTGACGTGCCATGTGATGCCACCCTG<br>ACAGAGAAGAGCTTCGAGACCGACATGAACCTGAATTTTCAGAATCTGCTCGTGATTGTCCT<br>GAGAATCCTGCTGCTGAAGGTGGCCGGCTTTAACCTGCTGATGACCCTGAGGCTGTGGAGCT<br>CCTGA | TCR 62 Native full sequence with mouse constant (nt) |
| 187 | MGTRLLCWAALCLLGAELTEAGVAQSPRYKIIEKRQSVAFWCNPISGHATLYWYQQILGQGP<br>KLLIQFQNNGVVDDSQLPKDRFSAERLKGVDSTLKIQPAKLEDSAVYLCASSLDTRGSSYNE<br>QFFGPGTRLTVLEDLNKVFPPEVAVFEPSEAEISHTQKATLVCLATGFFPDHVELSWWVNGK<br>EVHSGVCTDPQPLKEQPALNDSRYCLSSRLRVSATFWQNPRNHFRCQVQFYGLSENDEWTQD<br>RAKPVTQIVSAEAWGRADCGFTSVSYQQGVLSATILYEILLGKATLYAVLVSALVLMAMVKR<br>KDFGSGATNFSLLKQAGDVEENPGPMTRVSLLWAVVVSTCLESGMAQTVTQSQPEMSVQEAE<br>TVTLSCTYDTSENNYYLFWYKQPPSRQMILVIRQEAYKQQNATENRFSVNFQKAAKSFSLKI<br>SDSQLGDTAMYFCALYTYKYIFGTGTRLKVLANIQNPDPAVYQLRDSKSSDKSVCLFTDFDS<br>QTNVSQSKDSDVYITDKCVLDMRSMDFKSNSAVAWSNKSDFACANAFNNSIIPEDTFFPSPE<br>SSCDVKLVEKSFETDTNLNFQNLSVIGFRILLLKVAGFNLLMTLRLWSS | TCR 62 Full sequence with human constant (aa) |
| 188 | MGTRLLCWAALCLLGAELTEAGVAQSPRYKIIEKRQSVAFWCNPISGHATLYWYQQILGQGP<br>KLLIQFQNNGVVDDSQLPKDRFSAERLKGVDSTLKIQPAKLEDSAVYLCASSLDTRGSSYNE<br>QFFGPGTRLTVLEDLRNVTPPKVSLFEPSKAEIANKQKATLVCLARGFFPDHVELSWWVNGK<br>EVHSGVCTDPQAYKESNYSYCLSSRLRVSATFWHNPRNHFRCQVQFHGLSEEDKWPEGSPKP<br>VTQNISAEAWGRADCGITSASYQQGVLSATILYEILLGKATLYAVLVSTLVVMAMVKRKNSG<br>SGATNFSLLKQAGDVEENPGPMTRVSLLWAVVVSTCLESGMAQTVTQSQPEMSVQEAETVTL<br>SCTYDTSENNYYLFWYKQPPSRQMILVIRQEAYKQQNATENRFSVNFQKAAKSFSLKISDSQ<br>LGDTAMYFCALYTYKYIFGTGTRLKVLANIQNPEPAVYQLKDPRSQDSTLCLFTDFDSQINV<br>PKTMESGTFITDKCVLDMKAMDSKSNGAIAWSNQTSFTCQDIFKETNATYPSSDVPCDATLT<br>EKSFETDMNLNFQNLLVIVLRILLLKVAGFNLLMTLRLWSS | TCR 62 Full sequence with mouse constant (aa) |
| 189 | ATGGAGACTGTTCTGCACGTACTCCTAGGGATATTGGGGTTCCAAGCAGCCTGGGTCAGTAG<br>CCAAGAACTGGAGCAGAGTCCTCAGTCCTTGATCGTCCAAGAGGGAAAGAATCTCACCATAA<br>ACTGCACGTCATCAAAGACGTTATATGGCTTATACTGGTATAAGCAAAAGTATGGTGAAGGT<br>CTTATCTTCTTGATGATGCTACAGAAAGGTGGGAAGAGAAAAGTCATGAAAAGATAACTGC<br>CAAGTTGGATGAGAAAAGCAGCAAAGTTCCCTGCATATCACAGCCTCCCAGCCCAGCCATG<br>CAGGCATCTACCTCTGTGGAGCAGACATAGACGACTACAAGCTCAGCTTTGGAGCCGGAACC<br>ACAGTAACTGTAAGAGCAAATATCCAGAATCCGGACCccgcggtatatcaactgcgcgactc<br>aaaatcatccgataagagtgtctgtttgtttactgacttcgacagtcaaactaatgtctctc<br>agagcaaagattccgatgtctacatcactgacaagtgcgttctggatatgcggagcatggat | TCR 63 Alpha Native with Codon Optimized Human Constant (nt) |

SEQUENCE TABLE

| SEQ ID NO | SEQUENCE | Description |
|---|---|---|
| | tttaagtccaactccgccgtagcctggtccaacaagtcagactttgcctgtgcaaatgcttt<br>caacaactcaattatccctgaggacactttctttccttcaccggagtcctcatgcgatgtta<br>aactggtcgaaaaatcttttgagacggatacgaacctcaacttccaaaatttgagcgttatt<br>ggctttaggattctgcttctcaaggttgcggggttcaatctcctgatgacgttgcggctttg<br>gagcagctaa | |
| 190 | ATGGAGACTGTTCTGCACGTACTCCTAGGGATATTGGGGTTCCAAGCAGCCTGGGTCAGTAG<br>CCAAGAACTGGAGCAGAGTCCTCAGTCCTTGATCGTCCAAGAGGGAAAGAATCTCACCATAA<br>ACTGCACGTCATCAAAGACGTTATATGGCTTATACTGGTATAAGCAAAAGTATGGTGAAGGT<br>CTTATCTTCTTGATGATGCTACAGAAAGGTGGGGAAGAGAAAAGTCATGAAAAGATAACTGC<br>CAAGTTGGATGAGAAAAAGCAGCAAAGTTCCCTGCATATCACAGCCTCCCAGCCCAGCCATG<br>CAGGCATCTCTGTGGAGCAGACATAGACGACTACAAGCTCAGCTTTGGAGCCGGAACC<br>ACAGTAACTGTAAGAGCAAATATCCAGAATCCGGAGCCTGCCGTGTACCAGCTGAAGGACCC<br>ACGGAGCCAGGATAGCACCCTGTGCCTGTTCACCGACTTTGATTCTCAGATCAACGTGCCCA<br>AGACCATGGAGAGCGGCACCTTCATCACAGACAAGTGCGTGCTGGATATGAAGGCCATGGAC<br>AGCAAGTCCAACGGCGCCATCGCCTGGTCCAATCAGACATCTTTCACCTGCCAGGATATCTT<br>TAAGGAGACAAATGCCACCTATCCTTCCTCTGACGTGCCATGTGATGCCACCCTGACAGAGA<br>AGAGCTTCGAGACCGACATGAACCTGAATTTTCAGAATCTGCTCGTGATTGTCCTGAGAATC<br>CTGCTGCTGAAGGTGGCCGGCTTTAACCTGCTGATGACCCTGAGGCTGTGGAGCTCCTGA | TCR 63 Alpha Native with Codon Optimized Mouse Constant (nt) |
| 191 | SQELEQSPQSLIVQEGKNLTINCTSSKTLYGLYWYKQKYGEGLIFLMMLQKGGEEKSHEKIT<br>AKLDEKKQQSSLHITASQPSHAGIYLCGADIDDYKLSFGAGTTVTVRANIQNPDPAVYQLRD<br>SKSSDKSVCLFTDFDSQTNVSQSKDSDVYITDKCVLDMRSMDFKSNSAVAWSNKSDFACANA<br>FNNSIIPEDTFFPSPESSCDVKLVEKSFETDTNLNFQNLSVIGFRILLLKVAGFNLLMTLRL<br>WSS | TCR 63 Alpha with Codon Optimized Human Constant (aa) |
| 192 | SQELEQSPQSLIVQEGKNLTINCTSSKTLYGLYWYKQKYGEGLIFLMMLQKGGEEKSHEKIT<br>AKLDEKKQQSSLHITASQPSHAGIYLCGADIDDYKLSFGAGTTVTVRANIQNPEPAVYQLKD<br>PRSQDSTLCLFTDFDSQINVPKTMESGTFITDKCVLDMKAMDSKSNGAIAWSNQTSFTCQDI<br>FKETNATYPSSDVPCDATLTEKSFETDMNLNFQNLLVIVLRILLLKVAGFNLLMTLRLWSS | TCR 63 Alpha with Codon Optimized Mouse Constant (aa) |
| 193 | METVLHVLLGILGFQAAWVSSQELEQSPQSLIVQEGKNLTINCTSSKTLYGLYWYKQKYGEG<br>LIFLMMLQKGGEEKSHEKITAKLDEKKQQSSLHITASQPSHAGIYLCGADIDDYKLSFGAGT<br>TVTVRANIQNPDPAVYQLRDSKSSDKSVCLFTDFDSQTNVSQSKDSDVYITDKCVLDMRSMD<br>FKSNSAVAWSNKSDFACANAFNNSIIPEDTFFPSPESSCDVKLVEKSFETDTNLNFQNLSVI<br>GFRILLLKVAGFNLLMTLRLWSS | TCR 63 Alpha with Codon Optimized Human Constant and signal peptide (aa) |
| 194 | METVLHVLLGILGFQAAWVSSQELEQSPQSLIVQEGKNLTINCTSSKTLYGLYWYKQKYGEG<br>LIFLMMLQKGGEEKSHEKITAKLDEKKQQSSLHITASQPSHAGIYLCGADIDDYKLSFGAGT<br>TVTVRANIQNPEPAVYQLKDPRSQDSTLCLFTDFDSQINVPKTMESGTFITDKCVLDMKAMD<br>SKSNGAIAWSNQTSFTCQDIFKETNATYPSSDVPCDATLTEKSFETDMNLNFQNLLVIVLRI<br>LLLKVAGFNLLMTLRLWSS | TCR 63 Alpha with Codon Optimized Mouse Constant and signal peptide (aa) |
| 195 | SQELEQSPQSLIVQEGKNLTINCTSSKTLYGLYWYKQKYGEGLIFLMMLQKGGEEKSHEKIT<br>AKLDEKKQQSSLHITASQPSHAGIYLCGADIDDYKLSFGAGTTVTVRA | TCR 63 Alpha variable region (aa) |
| 196 | KTLYG | TCR 63 Alpha CDR1 (aa) |
| 197 | LQKGGEE | TCR 63 Alpha CDR2 (aa) |
| 198 | GADIDDYKLS | TCR 63 Alpha CDR3 (aa) |
| 199 | METVLHVLLGILGFQAAWVS | TCR 63 Alpha Signal peptide (aa) |
| 200 | ATGGGCACCAGGCTCCTCTGCTGGGTGGTCCTGGGTTTCCTAGGGACAGATCACACAGGTGC<br>TGGAGTCTCCCAGTCCCCTAGGTACAAAGTCGCAAAGAGAGGACAGGATGTAGCTCTCAGGT<br>GTGATCCAATTTCGGGTCATGTATCCCTTTTTGGTACCAACAGGCCTGGGGCAGGGGCCA<br>GAGTTTCTGACTTATTTCCAGAATGAAGCTCAACTAGACAAATCGGGGCTGCCCAGTGATCG<br>CTTCTTTGCAGAAAGGCCTGAGGGATCCGTCTCCACTCTGAAGATCCAGCGCACACAGCAGG<br>AGGACTCCGCCGTGTATCTCTGTGCCAGCAGACCAAGACAGGGGTATAATGACAATGAGCAG<br>TTCTTCGGGCCAGGGACACGGCTCACCGTGCTAgaggacctgaataaggtgttccccctga<br>ggtggccgtgtttgagccaagcgaggccagatctcccacacccagaaggccaccctggtgt<br>gcctggcaaccggcttctttcccgatcacgtggagctgtcctggtgggtgaacggcaaggag | TCR 63 Beta Native with Codon Optimized Human Constant (nt) |

SEQUENCE TABLE

| SEQ ID NO | SEQUENCE | Description |
|---|---|---|
| | gtgcactctggcgtgtgcacagacccacagcccctgaaggagcagcctgccctgaatgattc ccgctattgtctgtcctctcggctgagagtgtctgccacctttttggcagaacccacggaatc acttcagatgccaggtgcagttttacggcctgtctgagaacgacgagtggaccaggatcgg gccaagcctgtgacacagatcgtgagcgcggaagcatggggcagagccgactgtggcttcac cagcgtgtcctatcagcagggcgtgctgtccgccaccatcctgtacgagatcctgctgggca aggccacactgtatgccgtgctggtgtctgccctggtgctgatggccatggtgaagagaaaa gacttctaa | |
| 201 | ATGGGCACCAGGCTCCTCTGCTGGGTGGTCCTGGGTTTCCTAGGGACAGATCACACAGGTGC TGGAGTCTCCCAGTCCCTAGGTACAAAGTCGCAAAGAGAGGACAGGATGTAGCTCTCAGGT GTGATCCAATTTCGGGTCATGTATCCCTTTTTTGGTACCAACAGGCCCTGGGGCAGGGGCCA GAGTTTCTGACTTATTTCCAGAATGAAGCTCAACTAGACAAATCGGGGCTGCCCAGTGATCG CTTCTTTGCAGAAAGGCCTGAGGGATCCGTCTCCACTCTGAAGATCCAGCGCACACAGCAGG AGGACTCCGCCGTGTATCTCTGTGCCAGCAGACCAAGACAGGGGTATAATGACAATGAGCAG TTCTTCGGGCCAGGGACACGGCTCACCGTGCTAGAGGACCTGCGCAATGTGACCCCCCCTAA GGTGTCCCTGTTTGAGCCCTCTAAGGCCGAGATCGCCAACAAGCAGAAGGCCACCCTGGTGT GCCTGGCCAGAGGCTTCTTCCCTGATCACGTGGAGCTGAGCTGGTGGGTGAATGGCAAGGAG GTGCACTCCGGCGTGTGCACCGACCCACAGGCCTACAAGGAGTCCAACTACTCTTATTGTCT GTCCTCTAGGCTGCGCGTGAGCGCCACATTCTGGCACAACCCTCGGAATCACTTCAGATGCC AGGTGCAGTTTCACGGCCTGAGCGAGGAGGATAAGTGGCCAGAGGGCTCCCCAAAGCCCGTG ACCCAGAATATCTCTGCCGAGGCATGGGGCAGGGCCGACTGTGGAATCACCTCCGCCTCTTA TCAGCAGGGCGTGCTGTCCGCCACAATCCTGTACGAGATCCTGCTGGGCAAGGCCACCCTGT ATGCCGTGCTGGTGTCCACACTGGTGGTCATGGCCATGGTGAAGCGCAAGAACAGCtaa | TCR 63 Beta Native with Codon Optimized Mouse Constant (nt) |
| 202 | GAGVSQSPRYKVAKRGQDVALRCDPISGHVSLFWYQQALGQGPEFLTYFQNEAQLDKSGLPS DRFFAERPEGSVSTLKIQRTQQEDSAVYLCASRPRQGYNDNEQFFGPGTRLTVLEDLNKVFP PEVAVFEPSEAEISHTQKATLVCLATGFFPDHVELSWWVNGKEVHSGVCTDPQPLKEQPALN DSRYCLSSRLRVSATFWQNPRNHFRCQVFYGLSENDEWTQDRAKPVTQIVSAEAWGRADCG FTSVSYQQGVLSATILYEILLGKATLYAVLVSALVLMAMVKRKDF | TCR 63 Beta with Codon Optimized Human Constant (aa) |
| 203 | GAGVSQSPRYKVAKRGQDVALRCDPISGHVSLFWYQQALGQGPEFLTYFQNEAQLDKSGLPS DRFFAERPEGSVSTLKIQRTQQEDSAVYLCASRPRQGYNDNEQFFGPGTRLTVLEDLRNVTP PKVSLFEPSKAEIANKQKATLVCLARGFFPDHVELSWWVNGKEVHSGVCTDPQAYKESNYSY CLSSRLRVSATFWHNPRNHFRCQVFHGLSEEDKWPEGSPKPVTQNISAEAWGRADCGITSA SYQQGVLSATILYEILLGKATLYAVLVSTLVVMAMVKRKNS | TCR 63 Beta with Codon Optimized Mouse Constant (aa) |
| 204 | MGTRLLCWVVLGFLGTDHTGAGVSQSPRYKVAKRGQDVALRCDPISGHVSLFWYQQALGQGP EFLTYFQNEAQLDKSGLPSDRFFAERPEGSVSTLKIQRTQQEDSAVYLCASRPRQGYNDNEQ FFGPGTRLTVLEDLNKVFPPEVAVFEPSEAEISHTQKATLVCLATGFFPDHVELSWWVNGKE VHSGVCTDPQPLKEQPALNDSRYCLSSRLRVSATFWQNPRNHFRCQVFYGLSENDEWTQDR AKPVTQIVSAEAWGRADCGFTSVSYQQGVLSATILYEILLGKATLYAVLVSALVLMAMVKRK DF | TCR 63 Beta with Codon Optimized Human Constant and signal peptide (aa) |
| 205 | MGTRLLCWVVLGFLGTDHTGAGVSQSPRYKVAKRGQDVALRCDPISGHVSLFWYQQALGQGP EFLTYFQNEAQLDKSGLPSDRFFAERPEGSVSTLKIQRTQQEDSAVYLCASRPRQGYNDNEQ FFGPGTRLTVLEDLRNVTPPKVSLFEPSKAEIANKQKATLVCLARGFFPDHVELSWWVNGKE VHSGVCTDPQAYKESNYSYCLSSRLRVSATFWHNPRNHFRCQVFHGLSEEDKWPEGSPKPV TQNISAEAWGRADCGITSASYQQGVLSATILYEILLGKATLYAVLVSTLVVMAMVKRKNS | TCR 63 Beta with Codon Optimized Mouse Constant and signal peptide (aa) |
| 206 | GAGVSQSPRYKVAKRGQDVALRCDPISGHVSLFWYQQALGQGPEFLTYFQNEAQLDKSGLPS DRFFAERPEGSVSTLKIQRTQQEDSAVYLCASRPRQGYNDNEQFFGPGTRLTVL | TCR 63 Beta variable region (aa) |
| 207 | SGHVS | TCR 63 Beta CDR1 (aa) |
| 208 | FQNEAQ | TCR 63 Beta CDR2 (aa) |
| 209 | ASRPRQGYNDNEQF | TCR 63 Beta CDR3 (aa) |
| 210 | MGTRLLCWVVLGFLGTDHT | TCR 63 Beta signal peptide (aa) |
| 211 | ATGGGCACCAGGCTCCTCTGCTGGGTGGTCCTGGGTTTCCTAGGGACAGATCACACAGGTGC TGGAGTCTCCCAGTCCCTAGGTACAAAGTCGCAAAGAGAGGACAGGATGTAGCTCTCAGGT GTGATCCAATTTCGGGTCATGTATCCCTTTTTTGGTACCAACAGGCCCTGGGGCAGGGGCCA GAGTTTCTGACTTATTTCCAGAATGAAGCTCAACTAGACAAATCGGGGCTGCCCAGTGATCG CTTCTTTGCAGAAAGGCCTGAGGGATCCGTCTCCACTCTGAAGATCCAGCGCACACAGCAGG | TCR 63 Native full sequence with human constant (nt) |

| SEQ ID NO | SEQUENCE | Description |
|---|---|---|
| | AGGACTCCGCCGTGTATCTCTGTGCCAGCAGACCAAGACAGGGGTATAATGACAATGAGCAG<br>TTCTTCGGGCCAGGGACACGGCTCACCGTGCTAgaggacctgaataaggtgttcccccctga<br>ggtggccgtgtttgagccaagcgaggccgagatctcccacacccagaaggccaccctggtgt<br>gcctggcaaccggcttctttcccgatcacgtggagctgtcctggtgggtgaacggcaaggag<br>gtgcactctggcgtgtgcacagacccacagcccctgaaggagcagcctgccctgaatgattc<br>ccgctattgtctgtcctctcggctgagagtgtctgccacctttttggcagaacccacggaatc<br>acttcagatgccaggtgcagttttacggcctgtctgagaacgacgagtggacccaggatcgg<br>gccaagcctgtgacacagatcgtgagcgcggaagcatggggcagagccgactgtggcttcac<br>cagcgtgtcctatcagcagggcgtgctgtccgccaccatcctgtacgagatcctgctgggca<br>aggccacactgtatgccgtgctggtgtctgccctggtgctgatggccatggtgaagagaaaa<br>gacttctaaggctccggagcaaccaatttcagcctgctgaagcaggccggcgatgtggagga<br>gaatcctggcccaATGGAGACTGTTCTGCACGTACTCCTAGGGATATTGGGGTTCCAAGCAG<br>CCTGGGTCAGTAGCCAAGAACTGGAGCAGAGTCCTCAGTCCTTGATCGTCCAAGAGGGAAAG<br>AATCTCACCATAAACTGCACGTCATCAAAGACGTTATATGGCTTATACTGGTATAAGCAAAA<br>GTATGGTGAAGGTCTTATCTTCTTGATGATGCTACAGAAAGGTGGGGAAGAGAAAAGTCATG<br>AAAAGATAACTGCCAAGTTGGATGAGAAAAAGCAGCAAAGTTCCTGCATATCACAGCCTCC<br>CAGCCCAGCCATGCAGGCATCTACCTCTGTGGAGCAGACATAGACGACTACAAGCTCAGCTT<br>TGGAGCCGGAACCACAGTAACTGTAAGAGCAAATATCCAGAATCCGGACCCcgcggtatatc<br>aactgcgcgactcaaaatcatccgataagagtgtctgtttgtttactgacttcgacagtcaa<br>actaatgtctctcagagcaaagattccgatgtctacatcactgacaagtcgttctggatat<br>gcggagcatggatttttaagtccaactccgccgtagcctggtccaacaagtcagactttgcct<br>gtgcaaatgcttttcaacaactcaattatccctgaggacactttctttccttcaccggagtcc<br>tcatgcgatgttaaactggtcgaaaaatcttttgagacggatacgaacctcaacttccaaaa<br>tttgagcgttattggctttaggattctgcttctcaaggttgcggggttcaatctcctgatga<br>cgttgcggctttggagcagctaa | |
| 212 | ATGGGCACCAGGCTCCTCTGCTGGGTGGTCCTGGGTTTCCTAGGGACAGATCACACAGGTGC<br>TGGAGTCTCCCAGTCCCCTAGGTACAAAGTCGCAAAGAGAGGACAGGATGTAGCTCTCAGGT<br>GTGATCCAATTTCGGGTCATGTATCCCTTTTTGGTACCAACAGGCCCTGGGGCAGGGGCCA<br>GAGTTTCTGACTTATTTCCAGAATGAAGCTCAACTAGACAAATCGGGGCTGCCCAGTGATCG<br>CTTCTTTGCAGAAAGGCCTGAGGGATCCGTCTCCACTCTGAAGATCCAGCGCACACAGCAGG<br>AGGACTCCGCCGTGTATCTCTGTGCCAGCAGACCAAGACAGGGGTATAATGACAATGAGCAG<br>TTCTTCGGGCCAGGGACACGGCTCACCGTGCTAGAGGACCTGCGCAATGTGACCCCCCCTAA<br>GGTGTCCCTGTTTGAGCCCTCTAAGGCCGAGATCGCCAACAAGCAGAAGGCCACCCTGGTGT<br>GCCTGGCCAGAGGCTTCTTCCCTGATCACGTGGAGCTGAGCTGGTGGGTGAATGGCAAGGAG<br>GTGCACTCCGGCGTGTGCACCGACCCACAGGCCTACAAGGAGTCCAACTACTCTTATTGTCT<br>GTCCTCTAGGCTGCGCGTGAGCGCCACATTCTGGCACAACCCTCGGAATCACTTCAGATGCC<br>AGGTGCAGTTTCACGGCCTGAGCGAGGAGGATAAGTGGCCAGAGGGCTCCCCAAAGCCCGTG<br>ACCCAGAATATCTCTGCCGAGGCATGGGGCAGGGCCGACTGTGGAATCACCTCCGCCTCTTA<br>TCAGCAGGGCGTGCTGTCCGCCACAATCCTGTACGAGATCCTGCTGGGCAAGGCCACCCTGT<br>ATGCCGTGCTGGTGTCCACACTGGTGGTCATGGCCATGGTGAAGCGCAAGAACAGCtaaggc<br>tccggagcaaccaatttcagcctgctgaagcaggccggcgatgtggaggagaatcctggccc<br>aATGGAGACTGTTCTGCACGTACTCCTAGGGATATTGGGGTTCCAAGCAGCCTGGGTCAGTA<br>GCCAAGAACTGGAGCAGAGTCCTCAGTCCTTGATCGTCCAAGAGGGAAAGAATCTCACCATA<br>AACTGCACGTCATCAAAGACGTTATATGGCTTATACTGGTATAAGCAAAAGTATGGTGAAGG<br>TCTTATCTTCTTGATGATGCTACAGAAAGGTGGGGAAGAGAAAAGTCATGAAAAGATAACTG<br>CCAAGTTGGATGAGAAAAAGCAGCAAAGTTCCCTGCATATCACAGCCTCCCAGCCCAGCCAT<br>GCAGGCATCTACCTCTGTGGAGCAGACATAGACGACTACAAGCTCAGCTTTGGAGCCGGAAC<br>CACAGTAACTGTAAGAGCAAATATCCAGAATCCGGACCCTGCCGTGTACCAGCTGAAGGACC<br>CACGGAGCCAGGATAGCACCCTGTGCCTGTTCACCGACTTTGATTCTCAGATCAACGTGCCC<br>AAGACCATGGAGAGCGGCACCTTCATCACAGACAAGTGCGTGCTGGATATGAAGGCCATGGA<br>CAGCAAGTCCAACGGCGCCATCGCCTGGTCCAATCAGACATCTTTCACCTGCCAGGATATCT<br>TTAAGGAGACAAATGCCACCTATCCTTCCTCTGACGTGCCATGTGATGCCACCCTGACAGAG<br>AAGAGCTTCGAGACCGACATGAACCTGAATTTTCAGAATCTGCTCGTGATTGTCCTGAGAAT<br>CCTGCTGCTGAAGGTGGCCGGCTTTAACCTGCTGATGACCCTGAGGCTGTGGAGCTCCTGA | TCR 63 Native full sequence with mouse constant (nt) |
| 213 | MGTRLLCWVVLGFLGTDHTGAGVSQSPRYKVAKRGQDVALRCDPISGHVSLFWYQQALGQGP<br>EFLTYFQNEAQLDKSGLPSDRFFAERPEGSVSTLKIQRTQQEDSAVYLCASRPRQGYNDNEQ<br>FFGPGTRLTVLEDLNKVFPPEVAVFEPSEAEISHTQKATLVCLATGFFPDHVELSWWVNGKE<br>VHSGVCTDPQPLKEQPALNDSRYCLSSRLRVSATFWQNPRNHFRCQVQFYGLSENDEWTQDR<br>AKPVTQIVSAEAWGRADCGFTSVSYQQGVLSATILYEILLGKATLYAVLVSALVLMAMVKRK<br>DFGSGATNFSLLKQAGDVEENPGPMETVLHVLLGILGFQAAWVSSQELEQSPQSLIVQEGKN<br>LTINCTSSKTLYGLYWYKQKYGEGLIFLMMLQKGGEEKSHEKITAKLDEKKQQSSLHITASQ<br>PSHAGIYLCGADIDDYKLSFGAGTTVTVRANIQNPDPAVYQLRDSKSSDKSVCLFTDFDSQT<br>NVSQSKDSDVYITDKCVLDMRSMDFKSNSAVAWSNKSDFACANAFNNSIIPEDTFFPSPESS<br>CDVKLVEKSFETDTNLNFQNLSVIGFRILLLKVAGFNLLMTLRLWSS | TCR 63 Full sequence with human constant (aa) |
| 214 | MGTRLLCWVVLGFLGTDHTGAGVSQSPRYKVAKRGQDVALRCDPISGHVSLFWYQQALGQGP<br>EFLTYFQNEAQLDKSGLPSDRFFAERPEGSVSTLKIQRTQQEDSAVYLCASRPRQGYNDNEQ<br>FFGPGTRLTVLEDLRNVTPPKVSLFEPSKAEIANKQKATLVCLARGFFPDHVELSWWVNGKE<br>VHSGVCTDPQAYKESNYSYCLSSRLRVSATFWHNPRNHFRCQVQFHGLSEEDKWPEGSPKPV<br>TQNISAEAWGRADCGITSASYQQGVLSATILYEILLGKATLYAVLVSTLVVMAMVKRKNSGS<br>GATNFSLLKQAGDVEENPGPMETVLHVLLGILGFQAAWVSSQELEQSPQSLIVQEGKNLTIN | TCR 63 Full sequence with mouse constant (aa) |

| SEQ ID NO | SEQUENCE | Description |
|---|---|---|
| | CTSSKTLYGLYWYKQKYGEGLIFLMMLQKGGEEKSHEKITAKLDEKKQQSSLHITASQPSHA GIYLCGADIDDYKLSFGAGTTVTVRANIQNPEPAVYQLKDPRSQDSTLCLFTDFDSQINVPK TMESGTFITDKCVLDMKAMDSKSNGAIAWSNQTSFTCQDIFKETNATYPSSDVPCDATLTEK SFETDMNLNFQNLLVIVLRILLLKVAGFNLLMTLRLWSS | |
| 215 | ATGAACATGCTGACTGCCAGCCTGTTGAGGGCAGTCATAGCCTCCATCTGTGTTGTATCCAG CATGGCTCAGAAGGTAACTCAAGCGCAGACTGAAATTTCTGTGGTGGAGAAGGAGGATGTGA CCTTGGACTGTGTGTATGAAACCCGTGATACTACTTATTACTTATTCTGGTACAAGCAACCA CCAAGTGGAGAATTGGTTTTCCTTATTCGTCGGAACTCTTTTGATGAGCAAAATGAAATAAG TGGTCGGTATTCTTGGAACTTCCAGAAATCCACCAGTTCCTTCAACTTCACCATCACAGCCT CACAAGTCGTGGACTCAGCAGTATACTTCTGTGCTCTGAGTGGGGTCGATAACTATGGTCAG AATTTTGTCTTTGGTCCCGGAACCAGATTGTCCGTGCTGCCCAATATCCAGAATCCGGACCc cgcggtatatcaactgcgcgactcaaaatcatccgataagagtgtctgtttgtttactgact tcgacagtcaaactaatgtctctcagagcaaagattccgatgtctacatcactgacaagtgc gttctggatatgcggagcatggattttaagtccaactccgccgtagcctggtccaacaagtc agactttgctgtgcaaatgctttcaacaactcaattatccctgaggacactttctttcctt caccggagtcctcatgcgatgttaaactggtcgaaaaatctttgagacggatacgaacctc aacttccaaaatttgagcgttattggctttaggattctgcttctcaaggttgcggggttcaa tctcctgatgacgttgcggctttggagcagctaa | TCR 64 Alpha Native with Codon Optimized Human Constant (nt) |
| 216 | ATGAACATGCTGACTGCCAGCCTGTTGAGGGCAGTCATAGCCTCCATCTGTGTTGTATCCAG CATGGCTCAGAAGGTAACTCAAGCGCAGACTGAAATTTCTGTGGTGGAGAAGGAGGATGTGA CCTTGGACTGTGTGTATGAAACCCGTGATACTACTTATTACTTATTCTGGTACAAGCAACCA CCAAGTGGAGAATTGGTTTTCCTTATTCGTCGGAACTCTTTTGATGAGCAAAATGAAATAAG TGGTCGGTATTCTTGGAACTTCCAGAAATCCACCAGTTCCTTCAACTTCACCATCACAGCCT CACAAGTCGTGGACTCAGCAGTATACTTCTGTGCTCTGAGTGGGGTCGATAACTATGGTCAG AATTTTGTCTTTGGTCCCGGAACCAGATTGTCCGTGCTGCCCAATATCCAGAATCCGGAGCC TGCCGTGTACCAGCTGAAGGACCCACGGAGCCAGGATAGCACCCTGTGCCTGTTCACCGACT TTGATTCTCAGATCAACGTGCCCAAGACCATGGAGAGCGGCACCTTCATCACAGACAAGTGC GTGCTGGATATGAAGGCCATGGACAGCAAGTCCAACGGCGCCATCGCCTGGTCCAATCAGAC ATCTTTCACCTGCCAGGATATCTTTAAGGAGACAAATGCCACCTATCCTTCCTCTGACGTGC CATGTGATGCCACCCTGACAGAAGAGCTTCGAGACCGACATGAACCTGAATTTTCAGAAT CTGCTCGTGATTGTCCTGAGAATCCTGCTGCTGAAGGTGGCCGGCTTTAACCTGCTGATGAC CCTGAGGCTGTGGAGCTCCTGA | TCR 64 Alpha Native with Codon Optimized Mouse Constant (nt) |
| 217 | AQKVTQAQTEISVVEKEDVTLDCVYETRDTTYYLFWYKQPPSGELVFLIRRNSFDEQNEISG RYSWNFQKSTSSFNFTITASQVVDSAVYFCALSGVDNYGQNFVFGPGTRLSVLPNIQNPDPA VYQLRDSKSSDKSVCLFTDFDSQTNVSQSKDSDVYITDKCVLDMRSMDFKSNSAVAWSNKSD FACANAFNNSIIPEDTFFPSPESSCDVKLVEKSFETDTNLNFQNLSVIGFRILLLKVAGFNL LMTLRLWSS | TCR 64 Alpha with Codon Optimized Human Constant (aa) |
| 218 | AQKVTQAQTEISVVEKEDVTLDCVYETRDTTYYLFWYKQPPSGELVFLIRRNSFDEQNEISG RYSWNFQKSTSSFNFTITASQVVDSAVYFCALSGVDNYGQNFVFGPGTRLSVLPNIQNPEPA VYQLKDPRSQDSTLCLFTDFDSQINVPKTMESGTFITDKCVLDMKAMDSKSNGAIAWSNQTS FTCQDIFKETNATYPSSDVPCDATLTEKSFETDMNLNFQNLLVIVLRILLLKVAGFNLLMTL RLWSS | TCR 64 Alpha with Codon Optimized Mouse Constant (aa) |
| 219 | MNMLTASLLRAVIASICVVSSMAQKVTQAQTEISVVEKEDVTLDCVYETRDTTYYLFWYKQP PSGELVFLIRRNSFDEQNEISGRYSWNFQKSTSSFNFTITASQVVDSAVYFCALSGVDNYGQ NFVFGPGTRLSVLPNIQNPDPAVYQLRDSKSSDKSVCLFTDFDSQTNVSQSKDSDVYITDKC VLDMRSMDFKSNSAVAWSNKSDFACANAFNNSIIPEDTFFPSPESSCDVKLVEKSFETDTNL NFQNLSVIGFRILLLKVAGFNLLMTLRLWSS | TCR 64 Alpha with Codon Optimized Human Constant and signal peptide (aa) |
| 220 | MNMLTASLLRAVIASICVVSSMAQKVTQAQTEISVVEKEDVTLDCVYETRDTTYYLFWYKQP PSGELVFLIRRNSFDEQNEISGRYSWNFQKSTSSFNFTITASQVVDSAVYFCALSGVDNYGQ NFVFGPGTRLSVLPNIQNPEPAVYQLKDPRSQDSTLCLFTDFDSQINVPKTMESGTFITDKC VLDMKAMDSKSNGAIAWSNQTSFTCQDIFKETNATYPSSDVPCDATLTEKSFETDMNLNFQN LLVIVLRILLLKVAGFNLLMTLRLWSS | TCR 64 Alpha with Codon Optimized Mouse Constant and signal peptide (aa) |
| 221 | AQKVTQAQTEISVVEKEDVTLDCVYETRDTTYYLFWYKQPPSGELVFLIRRNSFDEQNEISG RYSWNFQKSTSSFNFTITASQVVDSAVYFCALSGVDNYGQNFVFGPGTRLSVLP | TCR 64 Alpha variable region (aa) |
| 222 | TRDTTYY | TCR 64 Alpha CDR1 (aa) |
| 223 | RNSFDEQN | TCR 64 Alpha CDR2 (aa) |

SEQUENCE TABLE

| SEQ ID NO | SEQUENCE | Description |
|---|---|---|
| 224 | ALSGVDNYGQNFV | TCR 64 Alpha CDR3 (aa) |
| 225 | MNMLTASLLRAVIASICVVSSM | TCR 64 Alpha Signal peptide (aa) |
| 226 | ATGGGCTGCAGGCTCCTCTGCTGTGTGGTCTTCTGCCTCCTCCAAGCAGGTCCCTTGGACAC AGCTGTTTCCCAGACTCCAAATACCTGGTCACACAGATGGGAAAGACAAGTCCATTAAAT GTGAACAAATCTGGGCCATGATACTATGTATTGGTATAAACAGGACTCTAAGAAATTTCTG AAGATAATGTTTAGCTACAATAATAAGGAGCTCATTATAAATGAAACAGTTCCAAATCGCTT CTCACCTAAATCTCCAGACAAAGCTCACTTAAATCTTCACATCAATTCCCTGGAGCTTGGTG ACTCTGCTGTGTATTTCTGTGCCAGCAGCCAGGGGAAGCTGGGGCCAACGTCCTGACTTTC GGGGCCGGCAGCAGGCTGACCGTGCTGgaggacctgaataaggtgttcccccctgaggtggc cgtgtttgagccaagcgaggccgagatctcccacacccagaagtgcacccttgtgtgcctgg caaccggcttcttttcccgatcacgtggagctgtcctggtgggtgaacggcaaggaggtgcac tctggcgtgtgcacagacccacagcccctgaaggagcagcctgccctgaatgattcccgcta ttgtctgtcctctcggctgagagtgtctgccacctttttggcagaacccacggaatcacttca gatgccaggtgcagttttacggcctgtctgagaacgacgagtggacccaggatcgggccaag cctgtgacacagatcgtgagcgcggaagcatggggcagagccgactgtggcttcaccagcgt gtcctatcagcagggcgtgctgtccgccaccatcctgtacgagatcctgctgggcaaggcca cactgtatgccgtgctggtgtctgccctggtgctgatggccatggtgaagagaaaagacttc taa | TCR 64 Beta Native with Codon Optimized Human Constant (nt) |
| 227 | ATGGGCTGCAGGCTCCTCTGCTGTGTGGTCTTCTGCCTCCTCCAAGCAGGTCCCTTGGACAC AGCTGTTTCCCAGACTCCAAATACCTGGTCACACAGATGGGAAACGACAAGTCCATTAAAT GTGAACAAATCTGGGCCATGATACTATGTATTGGTATAAACAGGACTCTAAGAAATTTCTG AAGATAATGTTTAGCTACAATAATAAGGAGCTCATTATAAATGAAACAGTTCCAAATCGCTT CTCACCTAAATCTCCAGACAAAGCTCACTTAAATCTTCACATCAATTCCCTGGAGCTTGGTG ACTCTGCTGTGTATTTCTGTGCCAGCAGCCAGGGGAAGCTGGGGCCAACGTCCTGACTTTC GGGGCCGGCAGCAGGCTGACCGTGCTGGAGGACCTGCGCAATGTGACCCCCCCTAAGGTGTC CCTGTTTGAGCCCTCTAAGGCCGAGATCGCCAACAAGCAGAAGGCCACCCTGGTGTGCCTGG CCAGAGGCTTCTTCCCTGATCACGTGGAGCTGAGCTGGTGGGTGAATGGCAAGGAGGTGCAC TCCGGCGTGTGCACCGACCCACAGGCCTACAAGGAGTCCAACTACTCTTATTGTCTGTCCTC TAGGCTGCGCGTGAGCGCCACATTCTGGCACAACCCTCGGAATACTTCAGATGCCAGGTGC AGTTTCACGGCCTGAGCGAGGAGGATAAGTGGCCAGAGGGCTCCCCAAAGCCCGTGACCCAG AATATCTCTGCCGAGGCATGGGGCAGGGCCGACTGTGGAATCACCTCCGCCTCTTATCAGCA GGGCGTGCTGTCCGCCACAATCCTGTACGAGATCCTGCTGGGCAAGGCCACCCTGTATGCCG TGCTGGTGTCCACACTGGTGGTCATGGCCATGGTGAAGCGCAAGAACAGCtaa | TCR 64 Beta Native with Codon Optimized Mouse Constant (nt) |
| 228 | DTAVSQTPKYLVTQMGNDKSIKCEQNLGHDTMYWYKQDSKKFLKIMFSYNNKELIINETVPN RFSPKSPDKAHLNLHINSLELGDSAVYFCASSQGEAGANVLTFGAGSRLTVLEDLNKVFPPE VAVFEPSEAEISHTQKATLVCLATGFFPDHVELSWWVNGKEVHSGVCTDPQPLKEQPALNDS RYCLSSRLRVSATFWQNPRNHFRCQVQFYGLSENDEWTQDRAKPVTQIVSAEAWGRADCGFT SVSYQQGVLSATILYEILLGKATLYAVLVSALVLMAMVKRKDF | TCR 64 Beta with Codon Optimized Human Constant (aa) |
| 229 | DTAVSQTPKYLVTQMGNDKSIKCEQNLGHDTMYWYKQDSKKFLKIMFSYNNKELIINETVPN RFSPKSPDKAHLNLHINSLELGDSAVYFCASSQGEAGANVLTFGAGSRLTVLEDLRNVTPPK VSLFEPSKAEIANKQKATLVCLARGFFPDHVELSWWVNGKEVHSGVCTDPQAYKESNYSYCL SSRLRVSATFWHNPRNHFRCQVQFHGLSEEDKWPEGSPKPVTQNISAEAWGRADCGITSASY QQGVLSATILYEILLGKATLYAVLVSTLVVMAMVKRKNS | TCR 64 Beta with Codon Optimized Mouse Constant (aa) |
| 230 | MGCRLLCCVVFCLLQAGPLDTAVSQTPKYLVTQMGNDKSIKCEQNLGHDTMYWYKQDSKKFL KIMFSYNNKELIINETVPNRFSPKSPDKAHLNLHINSLELGDSAVYFCASSQGEAGANVLTF GAGSRLTVLEDLNKVFPPEVAVFEPSEAEISHTQKATLVCLATGFFPDHVELSWWVNGKEVH SGVCTDPQPLKEQPALNDSRYCLSSRLRVSATFWQNPRNHFRCQVQFYGLSENDEWTQDRAK PVTQIVSAEAWGRADCGFTSVSYQQGVLSATILYEILLGKATLYAVLVSALVLMAMVKRKDF | TCR 64 Beta with Codon Optimized Human Constant and signal peptide (aa) |
| 231 | MGCRLLCCVVFCLLQAGPLDTAVSQTPKYLVTQMGNDKSIKCEQNLGHDTMYWYKQDSKKFL KIMFSYNNKELIINETVPNRFSPKSPDKAHLNLHINSLELGDSAVYFCASSQGEAGANVLTF GAGSRLTVLEDLRNVTPPKVSLFEPSKAEIANKQKATLVCLARGFFPDHVELSWWVNGKEVH SGVCTDPQAYKESNYSYCLSSRLRVSATFWHNPRNHFRCQVQFHGLSEEDKWPEGSPKPVTQ NISAEAWGRADCGITSASYQQGVLSATILYEILLGKATLYAVLVSTLVVMAMVKRKNS | TCR 64 Beta with Codon Optimized Mouse Constant and signal peptide (aa) |
| 232 | DTAVSQTPKYLVTQMGNDKSIKCEQNLGHDTMYWYKQDSKKFLKIMFSYNNKELIINETVPN RFSPKSPDKAHLNLHINSLELGDSAVYFCASSQGEAGANVLTFGAGSRLTVL | TCR 64 Beta variable region (aa) |

SEQUENCE TABLE

| SEQ ID NO | SEQUENCE | Description |
|---|---|---|
| 233 | LGHDT | TCR 64 Beta CDR1 (aa) |
| 234 | YNNKEL | TCR 64 Beta CDR2 (aa) |
| 235 | ASSQGEAGANVLT | TCR 64 Beta CDR3 (aa) |
| 236 | MGCRLLCCVVFCLLQAGPL | TCR 64 Beta signal peptide (aa) |
| 237 | ATGGGCTGCAGGCTCCTCTGCTGTGTGGTCTTCTGCCTCCTCCAAGCAGGTCCCTTGGACAC<br>AGCTGTTTCCCAGACTCCAAAATACCTGGTCACACAGATGGGAAACGACAAGTCCATTAAAT<br>GTGAACAAAATCTGGGCCATGATACTATGTATTGGTATAAACAGGACTCTAAGAAATTTCTG<br>AAGATAATGTTTAGCTACAATAATAAGGAGCTCATTATAAATGAAACAGTTCCAAATCGCTT<br>CTCACCTAAATCTCCAGACAAAGCTCACTTAAATCTTCACATCAATTCCCTGGAGCTTGGTG<br>ACTCTGCTGTGTATTTCTGTGCCAGCAGCCAGGGGAAGCTGGGGCAACGTCCTGACTTTC<br>GGGGCCGGCAGCAGGCTGACCGTGCTGgaggacctgaataaggtgttccccccctgaggtggc<br>cgtgtttgagccaagcgaggccgagatctcccacacccagaaggccacctggtgtgcctgg<br>caaccggcttctttcccgatcacgtggagctgtcctggtgggtgaacggcaaggaggtgcac<br>tctggcgtgtgcacagacccacagcccctgaaggagcagcctgccctgaatgattcccgcta<br>ttgtctgtcctctcggctgagagtgtctgccaccttttggcagaaccacgggaatcacttca<br>gatgccaggtgcagttttacggcctgtctgagaacgacgagtggacccaggatcgggccaag<br>cctgtgacacagatcgtgagcgcggaagcatggggcagagccgactgtggcttcaccagcgt<br>gtcctatcagcagggcgtgctgtccgccaccatcctgtacgagatcctgctgggcaaggcca<br>cactgtatgccgtgctggtgtctgcccctggtgctgatggccatggtgaagagaaaagacttc<br>taaggctccggagcaaccaatttcagcctgctgaagcaggccggcgatgtggaggagaatcc<br>tggcccaATGAACATGCTGACTGCCAGCCTGTTGAGGGCAGTCATAGCCTCCATCTGTGTTG<br>TATCCAGCATGGCTCAGAAGGTAACTCAAGCGCAGACTGAAATTTCTGTGGTGGAGAAGGAG<br>GATGTGACCTTGGACTGTGTGTATGAAACCCGTGATACTACTTATTACTTATTCTGGTACAA<br>GCAACCACCAAGTGGAGAATTGGTTTTCCTTATTCGTCGGAACTCTTTTGATGAGCAAAATG<br>AAATAAGTGGTCGGTATTCTTGGAACTTCCAGAAATCCACCAGTTCCTTCAACTTCACCATC<br>ACAGCCTCACAAGTCGTGGACTCAGCAGTATACTTCTGTGCTCTGAGTGGGGTCGATAACTA<br>TGGTCAGAATTTTGTCTTTGGTCCCGGAACCAGATTGTCCGTGCTGCCCAATATCCAGAATC<br>CGGACCccgcggtatatcaactgcgcgactcaaaatcatccgataagagtctgttttgttt<br>actgacttcgacagtcaaactaatgtctctcagagcaaagattccgatgtctacatcactga<br>caagtgcgttctggatatgcggagcatggattttaagtccaactccgcgtagcctggtcca<br>acaagtcagactttgcctgtgcaaatgctttcaacaactcaattatccctgaggacactttc<br>tttccttcaccggagtcctcatgcgatgttaaactggtcgaaaaatcttttgagacggatac<br>gaacctcaacttccaaaatttgagcgttattggctttaggattctgcttctcaaggttgcgg<br>ggttcaatctcctgatgacgttgcggctttggagcagctaa | TCR 64 Native full sequence with human constant (nt) |
| 238 | ATGGGCTGCAGGCTCCTCTGCTGTGTGGTCTTCTGCCTCCTCCAAGCAGGTCCCTTGGACAC<br>AGCTGTTTCCCAGACTCCAAAATACCTGGTCACACAGATGGGAAACGACAAGTCCATTAAAT<br>GTGAACAAAATCTGGGCCATGATACTATGTATTGGTATAAACAGGACTCTAAGAAATTTCTG<br>AAGATAATGTTTAGCTACAATAATAAGGAGCTCATTATAAATGAAACAGTTCCAAATCGCTT<br>CTCACCTAAATCTCCAGACAAAGCTCACTTAAATCTTCACATCAATTCCCTGGAGCTTGGTG<br>ACTCTGCTGTGTATTTCTGTGCCAGCAGCCAGGGGAAGCTGGGGCAACGTCCTGACTTTC<br>GGGGCCGGCAGCAGGCTGACCGTGCTGGAGGACCTGCGCAATGTGACCCCCCCTAAGGTGTC<br>CCTGTTTGAGCCCTCTAAGGCCGAGATCGCCAACAAGCAGAAGGCCAACCTGGTGTGCCTGG<br>CCAGAGGCTTCTTCCCTGATCACGTGGAGCTGAGCTGGTGGGTGAATGGCAAGGAGGTGCAC<br>TCCGGCGTGTGCACCGACCCACAGGCCTACAAGGAGTCCAACTACTCTTATTGTCTGTCCTC<br>TAGGCTGCGCGTGAGCGCCACATTCTGGCACAACCCTCGGAATCACTTCAGATGCCAGGTGC<br>AGTTTCACGGCCTGAGCGAGGAGGATAAGTGGCCAGAGGGCTCCCAAAGCCCGTGACCCAG<br>AATATCTCTGCCGAGGCATGGGCAGGGCCGACTGTGGAATCACCTCCGCCTCTTATCAGCA<br>GGGCGTGCTGTCCGCCACAATCCTGTACGAGATCCTGCTGGGCAAGGCCACCCTGTATGCCG<br>TGCTGGTGTCCACACTGGTGGTCATGGCCATGGTGAAGCGCAAGAACAGCtaaggctccgga<br>gcaaccaatttcagcctgctgaagcaggccggcgatgtggaggagaatcctggcccaATGAA<br>CATGCTGACTGCCAGCCTGTTGAGGGCAGTCATAGCCTCCATCTGTGTTGTATCCAGCATGG<br>CTCAGAAGGTAACTCAAGCGCAGACTGAAATTTCTGTGGTGGAGAAGGAGGATGTGACCTTG<br>GACTGTGTGTATGAAACCCGTGATACTACTTATTACTTATTCTGGTACAAGCAACCACCAAG<br>TGGAGAATTGGTTTTCCTTATTCGTCGGAACTCTTTTGATGAGCAAAATGAAATAAGTGGTC<br>GGTATTCTTGGAACTTCCAGAAATCCACCAGTTCCTTCAACTTCACCATCACAGCCTCACAA<br>GTCGTGGACTCAGCAGTATACTTCTGTGCTCTGAGTGGGGTCGATAACTATGGTCAGAATTT<br>TGTCTTTGGTCCCGGAACCAGATTGTCCGTGCTGCCCAATATCCAGAATCCGGAGCCTGCCG<br>TGTACCAGCTGAAGGACCCACGGAGCCAGGATAGCACCCTGTGCCTGTTCACCGACTTTGAT<br>TCTCAGATCAACGTGCCCAAGACCATGGAGAGCGGCACCTTCATCACAGACAAGTGCGTGCT<br>GGATATGAAGGCCATGGACAGCAAGTCCAACGGCGCCATCGCCTGGTCCAATCAGACATCTT<br>TCACCTGCCAGGATATCTTTAAGGAGACAAATGCCACCTATCCTTCCTCTGACGTGCCATGT<br>GATGCCACCCTGACAGAGAAGAGCTTCGAGACCGACATGAACCTGAATTTTCAGAATCTGCT | TCR 64 Native full sequence with mouse constant (nt) |

SEQUENCE TABLE

| SEQ ID NO | SEQUENCE | Description |
|---|---|---|
| | CGTGATTGTCCTGAGAATCCTGCTGCTGAAGGTGGCCGGCTTTAACCTGCTGATGACCCTGA<br>GGCTGTGGAGCTCCTGA | |
| 239 | MGCRLLCCVVFCLLQAGPLDTAVSQTPKYLVTQMGNDKSIKCEQNLGHDTMYWYKQDSKKFL<br>KIMFSYNNKELIINETVPNRFSPKSPDKAHLNLHINSLELGDSAVYFCASSQGEAGANVLTF<br>GAGSRLTVLEDLNKVFPPEVAVFEPSEAEISHTQKATLVCLATGFFPDHVELSWWVNGKEVH<br>SGVCTDPQPLKEQPALNDSRYCLSSRLRVSATFWQNPRNHFRCQVQFYGLSENDEWTQDRAK<br>PVTQIVSAEAWGRADCGFTSVSYQQGVLSATILYEILLGKATLYAVLVSALVLMAMVKRKDF<br>GSGATNFSLLKQAGDVEENPGPMNMLTASLLRAVIASICWSSMAQKVTQAQTEISVVEKED<br>VTLDCVYETRDTTYYLFWYKQPPSGELVFLIRRNSFDEQNEISGRYSWNFQKSTSSFNFTIT<br>ASQVVDSAVYFCALSGVDNYGQNFVFGPGTRLSVLPNIQNPDPAVYQLRDSKSSDKSVCLFT<br>DFDSQTNVSQSKDSDVYITDKCVLDMRSMDFKSNSAVAWSNKSDFACANAFNNSIIPEDTFF<br>PSPESSCDVKLVEKSFETDTNLNFQNLSVIGFRILLLKVAGFNLLMTLRLWSS | TCR 64 Full sequence with human constant (aa) |
| 240 | MGCRLLCCVVFCLLQAGPLDTAVSQTPKYLVTQMGNDKSIKCEQNLGHDTMYWYKQDSKKFL<br>KIMFSYNNKELIINETVPNRFSPKSPDKAHLNLHINSLELGDSAVYFCASSQGEAGANVLTF<br>GAGSRLTVLEDLRNVTPPKVSLFEPSKAEIANKQKATLVCLARGFFPDHVELSWWVNGKEVH<br>SGVCTDPQAYKESNYSYCLSSRLRVSATFWHNPRNHFRCQVQFHGLSEEDKWPEGSPKPVTQ<br>NISAEAWGRADCGITSASYQQGVLSATILYEILLGKATLYAVLVSTLVVMAMVKRKNSGSGA<br>TNFSLLKQAGDVEENPGPMNMLTASLLRAVIASICVVSSMAQKVTQAQTEISVVEKEDVTLD<br>CVYETRDTTYYLFWYKQPPSGELVFLIRRNSFDEQNEISGRYSWNFQKSTSSFNFTITASQV<br>VDSAVYFCALSGVDNYGQNFVFGPGTRLSVLPNIQNPEPAVYQLKDPRSQDSTLCLFTDFDS<br>QINVPKTMESGTFITDKCVLDMKAMDSKSNGAIAWSNQTSFTCQDIFKETNATYPSSDVPCD<br>ATLTEKSFETDMNLNFQNLLVIVLRILLLKVAGFNLLMTLRLWSS | TCR 64 Full sequence with mouse constant (aa) |
| 241 | ATGGAGAAAATGTTGGAGTGTGCATTCATAGTCTTGTGGCTTCAGCTTGGCTGGTTGAGTGG<br>AGAAGACCAGGTGACGCAGAGTCCCGAGGCCCTGAGACTCCAGGAGGGAGAGAGTAGCAGTC<br>TtAACTGCAGTTACACAGTCAGCGGTTTAAGAGGGCTGTTCTGGTATAGGCAAGATCCTGGG<br>AAAGGCCCTGAATTCCTCTTCACCCTGTATTCAGCTGGGGAAGAAAAGGAGAAAGAAAGGCT<br>AAAAGCCACATTAACAAAGAAGGAAAGCTTTCTGCACATCACAGCCCCTAAACCTGAAGACT<br>CAGCCCACTTATCTCTGTGCTGTGCAGGCAGAAAGAGGCTCAACCCTGGGGAGGCTATACTTT<br>GGAAGAGGAACTCAGTTGACTGTCTGGCCTAATATCCAGAATCCGGACCccgcggtatatca<br>actgcgcgactcaaaatcatccgataagagtgtctgtttgtttactgacttcgacagtcaaa<br>ctaatgtctctcagagcaaagattccgatgtctacatcactgacaagtgcgttctggatatg<br>cggagcatggattttaagtccaactccgccgtagcctggtccaacaagtcagactttgcctg<br>tgcaaatgctttcaacaactcaattatccctgaggacactttctttccttccaccggagtcct<br>catgcgatgttaaactggtcgaaaaatcttttgagacggatacgaacctcaacttccaaaat<br>ttgagcgttattggctttaggattctgcttctcaaggttgcggggttcaatctcctgatgac<br>gttgcggctttggagcagctaa | TCR 65 Alpha Native with Codon Optimized Human Constant (nt) |
| 242 | ATGGAGAAAATGTTGGAGTGTGCATTCATAGTCTTGTGGCTTCAGCTTGGCTGGTTGAGTGG<br>AGAAGACCAGGTGACGCAGAGTCCCGAGGCCCTGAGACTCCAGGAGGGAGAGAGTAGCAGTC<br>TtAACTGCAGTTACACAGTCAGCGGTTTAAGAGGGCTGTTCTGGTATAGGCAAGATCCTGGG<br>AAAGGCCCTGAATTCCTCTTCACCCTGTATTCAGCTGGGGAAGAAAAGGAGAAAGAAAGGCT<br>AAAAGCCACATTAACAAAGAAGGAAAGCTTTCTGCACATCACAGCCCCTAAACCTGAAGACT<br>CAGCCCACTTATCTCTGTGCTGTGCAGGCAGAAAGAGGCTCAACCCTGGGGAGGCTATACTTT<br>GGAAGAGGAACTCAGTTGACTGTCTGGCCTAATATCCAGAATCCGGAGCCTGCCGTGTACCA<br>GCTGAAGGACCCACGGAGCCAGGATAGCACCCTGTGCCTGTTCACCGACTTTGATTCTCAGA<br>TCAACGTGCCCAAGACCATGGAGAGCGGCACCTTCATCACAGACAAGTGCGTGCTGGATATG<br>AAGGCCATGGACAGCAAGTCCAACGGCGCCATCGCCTGGTCCAATCAGACATCTTTCACCTG<br>CCAGGATATCTTTAAGGAGACAAATGCCACCTATCCTTCCTCTGACGTGCCATGTGATGCCA<br>CCCTGACAGAGAAGAGCTTCGAGACCGACATGAACCTGAATTTTCAGAATCTGCTCGTGATT<br>GTCCTGAGAATCCTGCTGCTGAAGGTGGCCGGCTTTAACCTGCTGATGACCCTGAGGCTGTG<br>GAGCTCCTGA | TCR 65 Alpha Native with Cotton Optimized Mouse Constant (nt) |
| 243 | EDQVTQSPEALRLQEGESSSLNCSYTVSGLRGLFWYRQDPGKGPEFLFTLYSAGEEKEKERL<br>KATLTKKESFLHITAPKPEDSATYLCAVQAERGSTLGRLYFGRGTQLTVWPNIQNPDPAVYQ<br>LRDSKSSDKSVCLFTDFDSQTNVSQSKDSDVYITDKCVLDMRSMDFKSNSAVAWSNKSDFAC<br>ANAFNNSIIPEDTFFPSPESSCDVKLVEKSFETDTNLNFQNLSVIGFRILLLKVAGFNLLMT<br>LRLWSS | TCR 65 Alpha with Codon Optimized Human Constant (aa) |
| 244 | EDQVTQSPEALRLQEGESSSLNCSYTVSGLRGLFWYRQDPGKGPEFLFTLYSAGEEKEKERL<br>KATLTKKESFLHITAPKPEDSATYLCAVQAERGSTLGRLYFGRGTQLTVWPNIQNPEPAVYQ<br>LKDPRSQDSTLCLFTDFDSQINVPKTMESGTFITDKCVLDMKAMDSKSNGAIAWSNQTSFTC<br>QDIFKETNATYPSSDVPCDATLTEKSFETDMNLNFQNLLVIVLRILLLKVAGFNLLMTLRLW<br>SS | TCR 65 Alpha with Codon Optimized Mouse Constant (aa) |

| SEQ ID NO | SEQUENCE | Description |
|---|---|---|
| 245 | MEKMLECAFIVLWLQLGWLSGEDQVTQSPEALRLQEGESSSLNCSYTVSGLRGLFWYRQDPG KGPEFLFTLYSAGEEKEKERLKATLTKKESFLHITAPKPEDSATYLCAVQAERGSTLGRLYF GRGTQLTVWPNIQNPDPAVYQLRDSKSSDKSVCLFTDFDSQTNVSQSKDSDVYITDKCVLDM RSMDFKSNSAVAWSNKSDFACANAFNNSIIPEDTFFPSPESSCDVKLVEKSFETDTNLNFQN LSVIGFRILLLKVAGFNLLMTLRLWSS | TCR 65 Alpha with Codon Optimized Human Constant and signal peptide (aa) |
| 246 | MEKMLECAFIVLWLQLGWLSGEDQVTQSPEALRLQEGESSSLNCSYTVSGLRGLFWYRQDPG KGPEFLFTLYSAGEEKEKERLKATLTKKESFLHITAPKPEDSATYLCAVQAERGSTLGRLYF GRGTQLTVWPNIQNPEPAVYQLKDPRSQDSTLCLFTDFDSQINVPKTMESGTFITDKCVLDM KAMDSKSNGAIAWSNQTSFTCQDIFKETNATYPSSDVPCDATLTEKSFETDMNLNFQNLLVI VLRILLLKVAGFNLLMTLRLWSS | TCR 65 Alpha with Codon Optimized Mouse Constant and signal peptide (aa) |
| 247 | EDQVTQSPEALRLQEGESSSLNCSYTVSGLRGLFWYRQDPGKGPEFLFTLYSAGEEKEKERL KATLTKKESFLHITAPKPEDSATYLCAVQAERGSTLGRLYFGRGTQLTVWP | TCR 65 Alpha variable region (aa) |
| 248 | VSGLRG | TCR 65 Alpha CDR1 (aa) |
| 249 | LYSAGEE | TCR 65 Alpha CDR2 (aa) |
| 250 | AVQAERGSTLGRLY | TCR 65 Alpha CDR3 (aa) |
| 251 | MEKMLECAFIVLWLQLGWLSG | TCR 65 Alpha Signal peptide (aa) |
| 252 | ATGGGAATCAGGCTCCTCTGTCGTGTGGCCTTTTGTTTCCTGGCTGTAGGCCTCGTAGATGT GAAAGTAACCCAGAGCTCGAGATATCTAGTCAAAAGGACGGGAGAGAAAGTTTTTCTGGAAT GTGTCCAGGATATGGACCATGAAAATATGTTCTGGTATCGACAAGACCCAGGTCTGGGGCTA CGGCTGATCTATTTCTCATATGATGTTAAAATGAAAGAAAAGGAGATATTCCTGAGGGGTA CAGTGTCTCTAGAGAGAAGAAGGAGCGCTTCTCCCTGATTCTGGAGTCCGCCAGCACCAACC AGACATCTATGTACCTCTGTGCCAGCAGTTTATGGGGACGGCGAAACACCGGGGAGCTGTTT TTTGGAGAAGGCTCTAGGCTGACCGTACTGgaggacctgaataaggtgttcccccctgaggt ggccgtgtttgagccaagcgaggccgagatctcccacacccagaaggccaccctggtgtgcc tggcaaccggcttctttcccgatcacgtggagctgtcctggtgggtgaacggcaaggaggtg cactctggcgtgtgcacagacccacagcccctgaaggagcagcctgccctgaatgattcccg ctattgtctgtcctctcggctgagagtgtctgccaccttttggcagaacccacggaatcact tcagatgccaggtgcagttttacggcctgtctgagaacgacgaatggacccaggatcgggcc aagcctgtgacacagatcgtgagcgcggaagcatgggcagagccgactgtggcttcaccag cgtgtcctatcagcagggcgtgctgtccgccaccatcctgtacgagatcctgctgggcaagg ccacactgtatgccgtgctggtgtctgccctggtgctgatggccatggtgaagagaaaagac ttctaa | TCR 65 Beta Native with Codon Optimized Human Constant (nt) |
| 253 | ATGGGAATCAGGCTCCTCTGTCGTGTGGCCTTTTGTTTCCTGGCTGTAGGCCTCGTAGATGT GAAAGTAACCCAGAGCTCGAGATATCTAGTCAAAAGGACGGGAGAGAAAGTTTTTCTGGAAT GTGTCCAGGATATGGACCATGAAAATATGTTCTGGTATCGACAAGACCCAGGTCTGGGGCTA CGGCTGATCTATTTCTCATATGATGTTAAAATGAAAGAAAAGGAGATATTCCTGAGGGGTA CAGTGTCTCTAGAGAGAAGAAGGAGCGCTTCTCCCTGATTCTGGAGTCCGCCAGCACCAACC AGACATCTATGTACCTCTGTGCCAGCAGTTTATGGGGACGGCGAAACACCGGGGAGCTGTTT TTTGGAGAAGGCTCTAGGCTGACCGTACTGGAGGACCTGCGCAATGTGACCCCCCCTAAGGT GTCCCTGTTTGAGCCCTCTAAGGCCGAGATCGCCAACAAGCAGAAGGCCACCCTGGTGTGCC TGGCCAGAGGCTTCTTCCCTGATCACGTGGAGCTGAGCTGGTGGGTGAATGGCAAGGAGGTG CACTCCGGCGTGTGCACCGACCCACAGGCCTACAAGGAGTCCAACTACTCTTATTGTCTGTC CTCTAGGCTGCGCGTGAGCGCCACATTCTGGCACAACCCTCGGAATCACTTCAGATGCCAGG TGCAGTTTCACGGCCTGAGCGAGGAGGATAAGTGGCCAGAGGGCTCCCCAAAGCCCGTGACC CAGAATATCTCTGCCGAGGCATGGGCAGGGCCGACTGTGGAATCACCTCCGCCTCTTATCA GCAGGGCGTGCTGTCCGCCACAATCCTGTACGAGATCCTGCTGGGCAAGGCCACCCTGTATG CCGTGCTGGTGTCCACACTGGTGGTCATGGCCATGGTGAAGCGCAAGAACAGCtaa | TCR 65 Beta Native with Codon Optimized Mouse Constant (nt) |
| 254 | DVKVTQSSRYLVKRTGEKVFLECVQDMDHENMFWYRQDPGLGLRLIYFSYDVKMKEKGDIPE GYSVSREKKERFSLILESASTNQTSMYLCASSLWGRRNTGELFFGEGSRLTVEDLNKVFPP EVAVFEPSEAEISHTQKATLVCLATGFFPDHVELSWWVNGKEVHSGVCTDPQPLKEQPALND SRYCLSSRLRVSATFWQNPRNHFRCQVQFYGLSENDEWTQDRAKPVTQIVSAEAWGRADCGF TSVSYQQGVLSATILYEILLGKATLYAVLVSALVLMAMVKRKDF | TCR 65 Beta with Codon Optimized Human Constant (aa) |

-continued

SEQUENCE TABLE

| SEQ ID NO | SEQUENCE | Description |
|---|---|---|
| 255 | DVKVTQSSRYLVKRTGEKVFLECVQDMDHENMFWYRQDPGLGLRLIYFSYDVKMKEKGDIPE GYSVSREKKERFSLILESASTNQTSMYLCASSLWGRRNTGELFFGEGSRLTVLEDLRNVTPP KVSLFEPSKAEIANKQKATLVCLARGFFPDHVELSWWVNGKEVHSGVCTDPQAYKESNYSYC LSSRLRVSATFWHNPRNHFRCQVQFHGLSEEDKWPEGSPKPVTQNISAEAWGRADCGITSAS YQQGVLSATILYEILLGKATLYAVLVSTLVVMAMVKRKNS | TCR 65 Beta with Codon Optimized Mouse Constant (aa) |
| 256 | MGIRLLCRVAFCFLAVGLVDVKVTQSSRYLVKRTGEKVFLECVQDMDHENMFWYRQDPGLGL RLIYFSYDVKMKEKGDIPEGYSVSREKKERFSLILESASTNQTSMYLCASSLWGRRNTGELF FGEGSRLTVLEDLNKVFPPEVAVFEPSEAEISHTQKATLVCLATGFFPDHVELSWWVNGKEV HSGVCTDPQPLKEQPALNDSRYCLSSRLRVSATFWQNPRNHFRCQVQFYGLSENDEWTQDRA KPVTQIVSAEAWGRADCGFTSVSYQQGVLSATILYEILLGKATLYAVLVSALvLMAMVKRKD F | TCR 65 Beta with Codon Optimized Human Constant and signal peptide (aa) |
| 257 | MGIRLLCRVAFCFLAVGLVDVKVTQSSRYLVKRTGEKVFLECVQDMDHENMFWYRQDPGLGL RLIYFSYDVKMKEKGDIPEGYSVSREKKERFSLILESASTNQTSMYLCASSLWGRRNTGELF FGEGSRLTVLEDLRNVTPPKVSLFEPSKAEIANKQKATLVCLARGFFPDHVELSWWVNGKEV HSGVCTDPQAYKESNYSYCLSSRLRVSATFWHNPRNHFRCQVQFHGLSEEDKWPEGSPKPVT QNISAEAWGRADCGITSASYQQGVLSATILYEILLGKATLYAVLVSTLVVMAMVKRKNS | TCR 65 Beta with Codon Optimized Mouse Constant and signal peptide (aa) |
| 258 | DVKVTQSSRYLVKRTGEKVFLECVQDMDHENMFWYRQDPGLGLRLIYFSYDVKMKEKGDIPE GYSVSREKKERFSLILESASTNQTSMYLCASSLWGRRNTGELFFGEGSRLTVL | TCR 65 Beta variable region (aa) |
| 259 | MDHEN | TCR 65 Beta CDR1 (aa) |
| 260 | SYDVKM | TCR 65 Beta CDR2 (aa) |
| 261 | ASSLWGRRNTGELF | TCR 65 Beta CDR3 (aa) |
| 262 | MGIRLLCRVAFCFLAVGLV | TCR 65 Beta signal peptide (aa) |
| 263 | ATGGGAATCAGGCTCCTCTGTCGTGTGGCCTTTTGTTTCCTGGCTGTAGGCCTCGTAGATGT GAAAGTAACCCAGAGCTCGAGATATCTAGTCAAAAGGACGGGAGAGAAAGTTTTTCTGGAAT GTGTCCAGGATATGGACCATGAAAATATGTTCTGGTATCGACAAGACCCAGGTCTGGGCTA CGGCTGATCTATTTCTCATATGATGTTAAAATGAAAGAAAAAGGAGATATTCCTGAGGGGTA CAGTGTCTCTAGAGAGAAGAAGGAGCGCTTCTCCCTGATTCTGGAGTCCGCCAGCACCAACC AGACATCTATGTACCTCTGTGCCAGCAGTTTATGGGGACGGCGAAACACCGGGGAGCTGTTT TTTGGAGAAGGCTCTAGGCTGACCGTACTGgaggacctgaataaggtgttcccccctgaggt ggccgtgtttgagccaagcgaggccgagatctcccacacccagaaggccaccctggtgtgc tggcaaccggcttcttttcccgatcacgtggagctgtcctggtgggtgaacggcaaggaggtg cactctggcgtgtgcacagacccacagcccctgaaggagcagcctgcctgaatgattcccg ctattgtctgtcctctcggctgagagtgtctgccaccttttggcagaaccacggaatcact tcagatgccaggtgcagttttacggcctgtctgagaacgacgagtggacccaggatcgggcc aagcctgtgacacagatcgtgagcgcggaagcatggggcagagccgactgtggcttcaccag cgtgtcctatcagcagggcgtgctgtccgccaccatcctgtacgagatcctgctgggcaagg ccacactgtatgccgtgctggtgtctgccctggtgctgatggccatgGTgaagagaaaagac ttctaaggctccggagcaaccaatttcagcctgctgaagcaggccggcgatgtggaggagaa tcctggcccaATGGAGAAAATGTTGGAGTGTGCATTCATAGTCTTGTGGCTTCAGCTTGGCT GGTTGAGTGGAGAAGACCAGGTGACGCAGAGTCCCGAGGCCCTGAGACTCCAGGAGGGAGAG AGTAGCAGTCTtAACTGCAGTTTACACAGTCAGCGGTTTAAGAGGGCTGTTCTGGTATAGGCA AGATCCTGGGAAAGGCCCTGAATTCCTCTTCACCCTGTATTCAGCTGGGGAAGAAAAGGAGA AAGAAGGCTAAAAGCCACATTAACAAAGAAGGAAAGCTTTCTGCACATCACAGCCCCTAAA CCTGAAGACTCAGCCACTTATCTCTGTGCTGTGCAGGCAGAAAGAGGCTCAACCCTGGGGAG GCTATACTTTGGAAGAGGAACTCAGTTGACTGTCTGGCCTAATATCCAGAATCCGGACCCcg cggtatatcaactcgcgactcaaaatcatccgataagagtgtctgtttgtttactgacttc gacagtcaaactaatgtctctcagagcaaagattccgatgtctacatcactgacaagtgcgt tctggatatgcggagcatggatttaagtccaactccgccgtagcctggtccaacaagtcag actttgcctgtgcaaatgctttcaacaactcaattatccctgaggacactttctttccttca ccggagtcctcatgcgatgttaaactggtcgaaaaatcttttgagacggatacgaacctcaa cttccaaaatttgagcgttattggctttaggattctgcttctcaaggttgcggggttcaatc tcctgatgacgttgcggctttggagcagctaa | TCR 65 Native full sequence with human constant (nt) |

SEQUENCE TABLE

| SEQ ID NO | SEQUENCE | Description |
|---|---|---|
| 264 | ATGGGAATCAGGCTCCTCTGTCGTGTGGCCTTTTGTTTCCTGGCTGTAGGCCTCGTAGATGT GAAAGTAACCCAGAGCTCGAGATATCTAGTCAAAAGGACGGGAGAGAAAGTTTTTCTGGAAT GTGTCCAGGATATGGACCATGAAAATATGTTCTGGTATCGACAAGACCCAGGTCTGGGGCTA CGGCTGATCTATTTCTCATATGATGTTAAAATGAAAGAAAAAGGAGATATTCCTGAGGGGTA CAGTGTCTCTAGAGAGAAGAAGGAGCGCTTCTCCCTGATTCTGGAGTCCGCCAGCACCAACC AGACATCTATGTACCTCTGTGCCAGCAGTTTATGGGGACGGCGAAACACCGGGGAGCTGTTT TTTGGAGAAGGCTCTAGGCTGACCGTACTGGAGGACCTGCGCAATGTGACCCCCCCTAAGGT GTCCCTGTTTGAGCCCTCTAAGGCCGAGATCGCCAACAAGCAGAAGGCCACCCTGGTGTGCC TGGCCAGAGGCTTCTTCCCTGATCACGTGGAGCTGAGCTGGTGGGTAATGGCAAGGAGGTG CACTCCGGCGTGTGCACCGACCCACAGGCCTACAAGGAGTCCAACTACTGCTTATTGTCTGTC CTCTAGGCTGCGCGTGAGCGCCACATTCTGGCACAACCCTCGGAATCACTTCAGATGCCAGG TGCAGTTTCACGGCCTGAGCGAGGAGGATAAGTGGCCAGAGGGCTCCCCAAAGCCCGTGACC CAGAATATCTCTGCCGAGGCATGGGGCAGGGCCGACTGTGGAATCACCTCCGCCTCTTATCA GCAGGGCGTGCTGTCCGCCACAATCCTGTACGAGATCCTGCTGGGCAAGGCCACCCTGTATG CCGTGCTGGTGTCCACACTGGTGGTCATGGCCATGGTGAAGCGCAAGAACAGCtaaggctcc ggagcaaccaatttcagcctgctgaagcaggccggcgatgtggaggagaatcctggcccaAT GGAGAAAATGTTGGAGTGTGCATTCATAGTCTTGTGGCTTCAGCTTGGCTGGTTGAGTGGAG AAGACCAGGTGACGCAGAGTCCCGAGGCCCTGAGACTCCAGGAGGGAGAGAGTAGCAGTCTt AACTGCAGTTACACAGTCAGCGGTTTAAGAGGGCTGTTCTGGTATAGGCAAGATCCTGGAAA AGGCCCTGAATTCCTCTTCACCCTGTATTCAGCTGGGGAAGAAAAGGAGAAAGAAAGGCTAA AAGCCACATTAACAAAGAAGGAAAGCTTTCTGCACATCACAGCCCCTAAACCTGAAGACTCA GCCACTTATCTCTGTGCTGTGCAGGCAGAAAGAGGCTCAACCCTGGGGAGGCTATACTTTGG AAGAGGAACTCAGTTGACTGTCTGGCCTAATATCCAGAATCCGGAGCCTGCCGTGTACCAGC TGAAGGACCCACGGAGCCAGGATAGCACCCTGTGCCTGTTCACCGACTTTGATTCTCAGATC AACGTGCCCAAGACCATGGAGAGCGGCACCTTCATCACAGACAAGTGCGTGCTGGATATGAA GGCCATGGACAGCAAGTCCAACGGCGCCATCGCCTGGTCCAATCAGACATCTTTCACCTGCC AGGATATCTTTAAGGAGACAAATGCCACCTATCCTTCCTCTGACGTGCCATGTGATGCCACC CTGACAGAGAAGAGCTTCGAGACCGACATGAACCTGAATTTTCAGAATCTGCTCGTGATTGT CCTGAGAATCCTGCTGCTGAAGGTGGCCGGCTTTAACCTGCTGATGACCCTGAGGCTGTGGA GCTCCTGA | TCR 65 Native full sequence with mouse constant (nt) |
| 265 | MGIRLLCRVAFCFLAVGLVDVKVTQSSRYLVKRTGEKVFLECVQDMDHENMFWYRQDPGLGL RLIYFSYDVKMKEKGDIPEGYSVSREKKERFSLILESASTNQTSMYLCASSLWGRRNTGELF FGEGSRLTVLEDLNKVFPPEVAVFEPSEAEISHTQKATLVCLATGFFPDHVELSWWVNGKEV HSGVCTDPQPLKEQPALNDSRYCLSSRLRVSATFWQNPRNHFRCQVQFYGLSENDEWTQDRA KPVTQIVSAEAWGRADCGFTSVSYQQGVLSATILYEILLGKATLYAVLVSALVLMAMVKRKD FGSGATNFSLLKQAGDVEENPGPMEKMLECAFIVLWLQLGWLSGEDQVTQSPEALRLQEGES SSLNCSYTVSGLRGLFWYRQDPGKGPEFLFTLYSAGEEKEKERLKATLTKKESFLHITAPKP EDSATYLCAVQAERGSTLGRLYFGRGTQLTVWPNIQNPDPAVYQLRDSKSSDKSVCLFTDFD SQTNVSQSKDSDVYITDKCVLDMRSMDFKSNSAVAWSNKSDFACANAFNNSIIPEDTFFPSP ESSCDVKLVEKSFETDTNLNFQNLSVIGFRILLLKVAGFNLLMTLRLWSS | TCR 65 Full sequence with human constant (aa) |
| 266 | MGIRLLCRVAFCFLAVGLVDVKVTQSSRYLVKRTGEKVFLECVQDMDHENMFWYRQDPGLGL RLIYFSYDVKMKEKGDIPEGYSVSREKKERFSLILESASTNQTSMYLCASSLWGRRNTGELF FGEGSRLTVLEDLRNVTPPKVSLFEPSKAEIANKQKATLVCLARGFFPDHVELSWWVNGKEV HSGVCTDPQAYKESNYSYCLSSRLRVSATFWHNPRNHFRCQVQFHGLSEEDKWPEGSSPKVT QNISAEAWGRADCGITSASYQQGVLSATILYEILLGKATLYAVLVSTLVVMAMVKRKNSGSG ATNFSLLKQAGDVEENPGPMEKMLECAFIVLWLQLGWLSGEDQVTQSPEALRLQEGESSSLN CSYTVSGLRGLFWYRQDPGKGPEFLFTLYSAGEEKERLKATLTKKESFLHITAPKPEDSA TYLCAVQAERGSTLGRLYFGRGTQLTVWPNIQNPEPAVYQLKDPRSQDSTLCLFTDFDSQIN VPKTMESGTFITDKCVLDMKAMDSKSNGAIAWSNQTSFTCQDIFKETNATYPSSDVPCDATL TEKSFETDMNLNFQNLLVIVLRILLLKVAGFNLLMTLRLWSS | TCR 65 Full sequence with mouse constant (aa) |
| 267 | KLPQLCTEL | E6(18-26) peptide |
| 268 | TIHDIILECV | E6(29-38) peptide |
| 269 | FAFRDLCIV | E6(52-60) peptide |
| 270 | TLGIVCPI | E7(86-93) peptide |
| 271 | YMLDLQPET | E7(11-19) peptide |
| 272 | GTLGIVCPI | E7(85-93) peptide |

SEQUENCE TABLE

| SEQ ID NO | SEQUENCE | Description |
|---|---|---|
| 273 | LLMGTLGIV | E7(82-90) peptide |
| 274 | TLHEYMLDL | E7(7-15) peptide |
| 275 | DIQNPEPAVYQLKDPRSQDSTLCLFTDFDSQINVPKTMESGTFITDKTVLDMKAMDSKSNGA IAWSNQTSFTCQDIFKETNATYPSSDVPCDATLTEKSFETDMNLNFQNLSVMGLRILLLKVA GFNLLMTLRLWSS | Mouse alpha constant *Mus musculus* (aa) |
| 276 | NIQNPEPAVYQLKDPRSQDSTLCLFTDFDSQINVPKTMESGTFITDKTVLDMKAMDSKSNGA IAWSNQTSFTCQDIFKETNATYPSSDVPCDATLTEKSFETDMNLNFQNLSVMGLRILLLKVA GFNLLMTLRLWSS | Mouse alpha constant *Mus musculus* (aa) |
| 277 | NIQNPEPAVYQLKDPRSQDSTLCLFTDFDSQINVPKTMESGTFITDKCVLDMKAMDSKSNGA IAWSNQTSFTCQDIFKETNATYPSSDVPCDATLTEKSFETDMNLNFQNLLVIVLRILLLKVA GFNLLMTLRLWSS | Transmembrane-modified/cysteine modified mouse constant alpha *Mus musculus* (aa) |
| 278 | IQNPEPAVYQLKDPRSQDSTLCLFTDFDSQINVPKTMESGTFITDKCVLDMKAMDSKSNGAI AWSNQTSFTCQDIFKETNATYPSSDVPCDATLTEKSFETDMNLNFQNLLVIVLRILLLKVAG FNLLMTLRLWSS | Mouse alpha constant *Mus musculus* (aa) |
| 279 | NIQNPEPAVYQLKDPRSQDSTLCLFTDFDSQINVPKTMESGTFITDKTVLDMKAMDSKSNGA IAWSNQTSFTCQDIFKETNATYPSSDVPCDATLTEKSFETDMNLNFQNLSVMGLRILLLKVA GFNLLMTLRLWSS | Mouse alpha constant *Mus musculus* (aa) |
| 280 | NIQNPEPAVYQLKDPRSQDSTLCLFTDFDSQINVPKTMESGTFITDKXVLDMKAMDSKSNGA IAWSNQTSFTCQDIFKETNATYPSSDVPCDATLTEKSFETDMNLNFQNLXVXXLRILLLKVA GFNLLMTLRLWSS | Mouse alpha constant *Mus musculus* (aa) |
| 281 | NIQNPEPAVYQLKDPRSQDSTLCLFTDFDSQINVPKTMESGTFITDKCVLDMKAMDSKSNGA IAWSNQTSFTCQDIFKETNATYPSSDVPCDATLTEKSFETDMNLNFQNLSVMGLRILLLKVA GFNLLMTLRLWSS | Mouse alpha constant *Mus musculus* (aa) |
| 282 | NIQNPEPAVYQLKDPRSQDSTLCLFTDFDSQINVPKTMESGTFITDKTVLDMKAMDSKSNGA IAWSNQTSFTCQDIFKETNATYPSSDVPCDATLTEKSFETDMNLNFQNLLVIVLRILLLKVA GFNLLMTLRLWSS | Mouse alpha constant *Mus musculus* (aa) |
| 283 | DLRNVTPPKVSLFEPSKAEIANKQKATLVCLARGFFPDHVELSWWVNGKEVHSGVSTDPQAY KESNYSYCLSSRLRVSATFWHNPRNHFRCQVQFHGLSEEDKWPEGSPKPVTQNISAEAWGRA DCGITSASYHQGVLSATILYEILLGKATLYAVLVSGLVLMAMVKRKNS | Mouse beta constant *Mus musculus* (aa) |
| 284 | EDLRNVTPPKVSLFEPSKAEIANKQKATLVCLARGFFPDHVELSWWVNGKEVHSGVSTDPQA YKESNYSYCLSSRLRVSATFWHNPRNHFRCQVQFHGLSEEDKWPEGSPKPVTQNISAEAWGR ADCGITSASYQQGVLSATILYEILLGKATLYAVLVSTLVVMAMVKRKNS | Mouse beta constant *Mus musculus* (aa) |
| 285 | EDLRNVTPPKVSLFEPSKAEIANKQKATLVCLARGFFPDHVELSWWVNGKEVHSGVXTDPQA YKESNYSYCLSSRLRVSATFWHNPRNHFRCQVQFHGLSEEDKWPEGSPKPVTQNISAEAWGR ADCGITSASYQQGVLSATILYEILLGKATLYAVLVSTLVVMAMVKRKNS | Mouse beta constant *Mus musculus* (aa) |
| 286 | MKTFAGFSFLFLWLQLDCMSR | Signal sequence |
| 287 | PGGG-(SGGGG)n-P- wherein n is 5 or 6, P is proline, G is glycine and S is serine | Linker (aa) |

| SEQ ID NO | SEQUENCE | Description |
|---|---|---|
| 288 | GSADDAKKDAAKKDGKS | Linker (aa) |
| 289 | $X_1X_2X_3X_4X_5X_6X_7X_8X_9X_{10}X_{11}X_{12}X_{13}$<br>$X_1$ = A or S;<br>$X_2$ = A, I, S, or Y;<br>$X_3$ = S, T, or R;<br>$X_4$ = G, K, R, L, P, S, or Q;<br>$X_5$ = D, G, R, T, or W;<br>$X_6$ = A, E, F, R, S, Q, T or V;<br>$X_7$ = A, R, G, Y, or null;<br>$X_8$ = G, N, S, or null;<br>$X_9$ = A, D, G, S, or Y;<br>$X_{10}$ = L, N, or Y;<br>$X_{11}$ = E or V;<br>$X_{12}$ = L or Q;<br>$X_{13}$ = F, Y, or T | TCR E7(11-19) beta overall CDR3 consensus |
| 290 | $X_1X_2X_3X_4X_5X_6X_7X_8X_9X_{10}$EQF<br>$X_1$ = A or S;<br>$X_2$ = A or S;<br>$X_3$ = S or R;<br>$X_4$ = S, L, or P;<br>$X_5$ = W, D, or R;<br>$X_6$ = R, T, or Q;<br>$X_7$ = R, G, Y, or null;<br>$X_8$ = G, N, or S;<br>$X_9$ = G, D, or Y;<br>$X_{10}$ = N or L | TCR E7(11-19) beta CDR3 consensus |
| 291 | $X_1X_2X_3X_4X_5X_6X_7$YEQY<br>$X_1$ = A or S;<br>$X_2$ = I, S, or Y;<br>$X_3$ = S or T;<br>$X_4$ = G, P, R, or T;<br>$X_5$ = R or T;<br>$X_6$ = F, S, A, or V;<br>$X_7$ = S or T | TCR E7(11-19) beta CDR3 consensus |
| 292 | $X_1X_2X_3X_4X_5X_6X_7X_8X_9X_{10}X_{11}X_{12}X_{13}$<br>$X_1$ = A or G;<br>$X_2$ = A, G, P, V, or L;<br>$X_3$ = A, K, N, Y, D, or S;<br>$X_4$ = R, M, I, T, or G;<br>$X_5$ = N, E, L, D, V, or null;<br>$X_6$ = Y, G, N, D, or null;<br>$X_7$ = S, N, G, or null;<br>$X_8$ = G, N, Y, or null;<br>$X_9$ = D, F, G, N, or null;<br>$X_{10}$ = A, N, Q, or Y;<br>$X_{11}$ = K, R, or N;<br>$X_{12}$ = F, L, or Y;<br>$X_{13}$ = I, M, S, T, V, or Y | TCR E7(11-19) alpha overall CDR3 consensus |
| 293 | AVN$X_4X_5X_6X_7X_8$N$X_{10}X_{11}$L$X_{13}$<br>$X_4$ = M or I;<br>$X_5$ = E or L;<br>$X_6$ = G or N;<br>$X_7$ = S, G, or null;<br>$X_8$ = S or N;<br>$X_{10}$ = Y or A;<br>$X_{11}$ = K or R;<br>$X_{13}$ = T or M | TCR E7(11-19) alpha CDR3 consensus |
| 294 | MDTWLVCWAIFSLLKAGLT | Signal Sequence |
| 295 | GAATCTAAGTACGGACCGCCCTGCCCCCCTTGCCCT | spacer (IgG4hinge) Homo sapiens (nt) |

| SEQ ID NO | SEQUENCE | Description |
|---|---|---|
| 296 | ESKYGPPCPPCPGQPREPQVYTLPPSQEEMTKNQVSLTCLVKGFYPSDIAVEWESNGQPENN YKTTPPVLDSDGSFFLYSRLTVDKSRWQEGNVFSCSVMHEALHNHYTQKSLSLSLGK | Hinge-CH3 spacer *Homo sapiens* (aa) |
| 297 | ESKYGPPCPPCPAPEFLGGPSVFLFPPKPKDTLMISRTPEVTCVVVDVSQEDPEVQFNWYVD GVEVHNAKTKPREEQFNSTYRVVSVLTVLHQDWLNGKEYKCKVSNKGLPSSIEKTISKAKGQ PREPQVYTLPPSQEEMTKNQVSLTCLVKGFYPSDIAVEWESNGQPENNYKTTPPVLDSDGSF FLYSRLTVDKSRWQEGNVFSCSVMHEALHNHYTQKSISISLGK | Hinge-CH2-CH3 spacer *Homo sapiens* (aa) |
| 298 | RWPESPKAQASSVPTAQPQAEGSLAKATTAPATTRNTGRGGEEKKKEKEKEEQEERETKTPE CPSHTQPLGVYLLTPAVQDLWLRDKATFTCFVVGSDLKDAHLTWEVAGKVPTGGVEEGLLER HSNGSQSQHSRLTLPRSLWNAGTSVTCTLNHPSLPPQRLMALREPAAQAPVKLSLNLLASSD PPEAASWLLCEVSGFSPPNILLMWLEDQREVNTSGFAPARPPPQPGSTTFWAWSVLRVPAPP SPQPATYTCVVSHEDSRTLLNASRSLEVSYVTDH | IgD-hinge-Fc *Homo sapiens* (aa) |
| 299 | MLLLVTSLLLCELPHPAFLLIPRKVCNGIGIGEFKDSLSINATNIKHFKNCTSISGDLHILP VAFRGDSFTHTPPLDPQELDILKTVKEITGFLLIQAWPENRTDLHAFENLEIIRGRTKQHGQ FSLAVVSLNITSLGLRSLKEISDGDVIISGNKNLCYANTINWKKLFGTSGQKTKIISNRGEN SCKATGQVCHALCSPEGCWGPEPRDCVSCRNVSRGRECVDKCNLLEGEPREFVENSECIQCH PECLPQAMNITCTGRGPDNCIQCAHYIDGPHCVKTCPAGVMGENNTLVWKYADAGHVCHLCH PNCTYGCTGPGLEGCPTNGPKIPSIATGMVGALLLLLVVALGIGLFM | tEGFR artificial (aa) |
| 300 | RKVCNGIGIGEFKDSLSINATNIKHFKNCTSISGDLHILPVAFRGDSFTHTPPLDPQELDIL KTVKEITGFLLIQAWPENRTDLHAFENLEIIRGRTKQHGQFSLAVVSLNITSLGLRSLKEIS DGDVIISGNKNLCYANTINWKKLFGTSGQKTKIISNRGENSCKATGQVCHALCSPEGCWGPE PRDCVSCRNVSRGRECVDKCNLLEGEPREFVENSECIQCHPECLPQAMNITCTGRGPDNCIQ CAHYIDGPHCVKTCPAGVMGENNTLVWKYADAGHVCHLCHPNCTYGCTGPGLEGCPTNGPKI PSIATGMVGALLLLLVVALGIGLFM | tEGFR artificial |
| 301 | LEGGGEGRGSLLTCGDVEENPGPR | T2A Artificial (aa) |
| 302 | EGRGSLLTCGDVEENPGP | T2A Artificial (aa) |
| 303 | FWVLVVVGGVLACYSLLVTVAFIIFWV | CD28 (amino acids 153-179 of Accession No. P10747) *Homo sapiens* (aa) |
| 304 | IEVMYPPPYLDNEKSNGTIIHVKGKHLCPSPLFPGPSKP FWVLVVVGGVLACYSLLVTVAFIIFWV | CD28 (amino acids 114-179 of Accession No. P10747) *Homo sapiens* (aa) |
| 305 | RSKRSRLLHSDYMNMTPRRPGPTRKHYQPYAPPRDFAAYRS | CD28 (amino acids 180-220 of P10747) *Homo sapiens* (aa) |
| 306 | RSKRSRGGHSDYMNMTPRRPGPTRKHYQPYAPPRDFAAYRS | CD28 (LL to GG) *Homo sapiens* (aa) |
| 307 | KRGRKKLLYIFKQPFMRPVQTTQEEDGCSCRFPEEEEGGCEL | 4-1BB (amino acids 214-255 of Q07011.1) *Homo sapiens* (aa) |
| 308 | RVKFSRSADAPAYQQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR | CD3 zeta *Homo sapiens* (aa) |

| SEQ ID NO | SEQUENCE | Description |
|---|---|---|
| 309 | RVKFSRSAEPPAYQQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR | CD3 zeta Homo sapiens (aa) |
| 310 | RVKFSRSADAPAYKQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR | CD3 zeta Homo sapiens (aa) |
| 311 | ATNFSLLKQAGDVEENPGP | P2A |
| 312 | VKQTLNFDLLKLAGDVESNPGP | F2A |
| 313 | QCTNYALLKLAGDVESNPGP | E2A |
| 314 | ESKYGPPCPPCP | spacer (IgG4hinge) Homo sapiens (aa) |
| 315 | GGCTCCGGCGCCACAAACTTTTCTCTGCTGAAGCAGGCAGGCGATGTGGAGGAGAACCCTGG ACCA | P2A Artificial (nt) |
| 316 | GGAAGCGGAGCCACCAACTTTTCCCTGCTGAAGCAGGCCGGCGATGTGGAGGAGAATCCTGG CCCA | P2A Artificial (nt) |
| 317 | GGATCTGGAGCCACCAACTTCTCCCTGCTGAAGCAGGCCGGCGATGTGGAGGAGAATCCTGG CCCA | P2A Artificial (nt) |
| 318 | GGATCCGGAGCTACCAACTTCTCTCTGCTGAAACAGGCAGGCGATGTGGAGGAAAATCCTGG GCCA | P2A Artificial (nt) |
| 319 | GGGAGTGGAGCAACAAACTTTTCACTGCTGAAGCAGGCCGGCGATGTGGAGGAAAATCCTGG GCCA | P2A Artificial (nt) |
| 320 | GGGTCCGGAGCCACAAATTTTTCTCTGCTGAAACAGGCTGGCGATGTGGAGGAAAACCCTGG GCCA | P2A Artificial (nt) |
| 321 | GGAAGCGGCGCAACAAACTTTTCCCTGCTGAAACAGGCCGGAGATGTGGAGGAAAATCCTGG CCCA | P2A Artificial (nt) |
| 322 | ggaagcggcgccacaaacttctcactgctgaaacaggccggcgacgtggaggagaatcctgg ccca | P2A Artificial (nt) |
| 323 | ggcagcggcgccaccaacttcagcctgcttaaacaggcaggcgacgtggaggagaatcctgg ccca | P2A Artificial (nt) |
| 324 | ggctctggcgccaccaactttagcctgctgaagcaggccggcgatgtggaggagaatcctgg ccca | P2A Artificial (nt) |
| 325 | ggaagcggcgccacaaacttctcactgctgaaacaggctggcgacgtggaggagaatcctgg ccca | P2A Artificial (nt) |
| 326 | ggcagcggcgccaccaacttcagcctgcttaaacaagctggcgacgtggaggagaatcctgg ccca | P2A Artificial (nt) |
| 327 | MKKHLTTFLVILWLYFYRGNG | Signal sequence |
| 328 | METLLGLLILWLQLQWVSS | Signal sequence |
| 329 | MSLGLLCCGAFSLLWAGPV | Signal sequence |
| 330 | MLSLLLLLLGLGSVF | Signal sequence |
| 331 | MLLLLVPVLEVIFTLGGTR | Signal sequence |
| 332 | MEKNPLAAPLLILWFHLDCVSS | Signal sequence |
| 333 | NIQKPDPAVYQLRDSKSSDKSVCLFTDFDSQTNVSQSKDSDVYITDKTVLDMRSMDFKSNSA VAWSNKSDFACANAFNNSIIPADTFFPSPESSCDVKLVEKSFETDTNLNFQNLSVIGFRILL LKVAGFNLLMTLRLWSS | Native TCR alpha constant region Homo sapiens (aa) |

SEQUENCE TABLE

| SEQ ID NO | SEQUENCE | Description |
|---|---|---|
| 334 | NIQNPDPAVYQLRDSKSSDKSVCLFTDFDSQTNVSQSKDSDVYITDKTVLDMRSMDFKSNSA VAWSNKSDFACANAFNNSIIPEDTFFPSPESSCDVKLVEKSFETDTNLNFQNLSVIGFRILL LKVAGFNLLMTLRLWSS | Native TCR alpha constant region Homo sapiens (aa) |
| 335 | HIQNPDPAVYQLRDSKSSDKSVCLFTDFDSQTNVSQSKDSDVYITDKTVLDMRSMDFKSNSA VAWSNKSDFACANAFNNSIIPEDTFFPSPESSCDVKLVEKSFETDTNLNFQNLSVIGFRILL LKVAGFNLLMTLRLWSS | Native TCR alpha constant region Homo sapiens (aa) |
| 336 | YIQNPDPAVYQLRDSKSSDKSVCLFTDFDSQTNVSQSKDSDVYITDKTVLDMRSMDFKSNSA VAWSNKSDFACANAFNNSIIPEDTFFPSPESSCDVKLVEKSFETDTNLNFQNLSVIGFRILL LKVAGFNLLMTLRLWSS | Native TCR alpha constant region Homo sapiens (aa) |
| 337 | DIQNPDPAVYQLRDSKSSDKSVCLFTDFDSQTNVSQSKDSDVYITDKTVLDMRSMDFKSNSA VAWSNKSDFACANAFNNSIIPEDTFFPSPESSCDVKLVEKSFETDTNLNFQNLSVIGFRILL LKVAGFNLLMTLRLWSS | Native TCR alpha constant region Homo sapiens (aa) |
| 338 | PNIQKPDPAVYQLRDSKSSDKSVCLFTDFDSQTNVSQSKDSDVYITDKTVLDMRSMDFKSNS AVAWSNKSDFACANAFNNSIIPADTFFPSPESSCDVKLVEKSFETDTNLNFQNLSVIGFRIL LLKVAGFNLLMTLRLWSS | Native TCR alpha constant region Homo sapiens (aa) |
| 339 | EDLNKVFPPEVAVFEPSEAEISHTQKATLVCLATGFFPDHVELSWWVNGKEVHSGVSTDPQP LKEQPALNDSRYCLSSRLRVSATFWQNPRNHFRCQVQFYGLSENDEWTQDRAKPVTQIVSAE AWGRADCGFTSVSYQQGVLSATILYEILLGKATLYAVLVSALVLMAMVKRKDF | Native TCR beta constant region Homo sapiens (aa) |
| 340 | EDLKNVFPPEVAVFEPSEAEISHTQKATLVCLATGFYPDHVELSWWVNGKEVHSGVSTDPQP LKEQPALNDSRYCLSSRLRVSATFWQNPRNHFRCQVQFYGLSENDEWTQDRAKPVTQIVSAE AWGRADCGFTSESYQQGVLSATILYEILLGKATLYAVLVSALVLMAMVKRKDSRG | Native TCR beta constant region Homo sapiens (aa) |
| 341 | PNIQNPDPAVYQLRDSKSSDKSVCLFTDFDSQTNVSQSKDSDVYITDKTVLDMRSMDFKSNS AVAWSNKSDFACANAFNNSIIPEDTFFPSPESSCDVKLVEKSFETDTNLNFQNLSVIGFRIL LLKVAGFNLLMTLRLWSS | Native TCR alpha constant region Homo sapiens (aa) |
| 342 | TEDLKNVFPPEVAVFEPSEAEISHTQKATLVCLATGFYPDHVELSWWVNGKEVHSGVSTDPQ PLKEQPALNDSRYCLSSRLRVSATFWQNPRNHFRCQVQFYGLSENDEWTQDRAKPVTQIVSA EAWGRADCGFTSESYQQGVLSATILYEILLGKATLYAVLVSALVLMAMVKRKDSRG | Native TCR beta constant region Homo sapiens (aa) |
| 343 | LEDLKNVFPPEVAVFEPSEAEISHTQKATLVCLATGFYPDHVELSWWVNGKEVHSGVSTDPQ PLKEQPALNDSRYCLSSRLRVSATFWQNPRNHFRCQVQFYGLSENDEWTQDRAKPVTQIVSA EAWGRADCGFTSESYQQGVLSATILYEILLGKATLYAVLVSALVLMAMVKRKDSRG | Native TCR beta constant region Homo sapiens (aa) |
| 344 | NIQKPDPAVYQLRDSKSSDKSVCLFTDFDSQTNVSQSKDSDVYITDKCVLDMRSMDFKSNSA VAWSNKSDFACANAFNNSIIPADTFFPSPESSCDVKLVEKSFETDTNLNFQNLSVIGFRILL LKVAGFNLLMTLRLWSS | TCR alpha constant region Homo sapiens (aa) |
| 345 | HIQNPDPAVYQLRDSKSSDKSVCLFTDFDSQTNVSQSKDSDVYITDKCVLDMRSMDFKSNSA VAWSNKSDFACANAFNNSIIPEDTFFPSPESSCDVKLVEKSFETDTNLNFQNLSVIGFRILL LKVAGFNLLMTLRLWSS | TCR alpha constant region Homo sapiens (aa) |

SEQUENCE TABLE

| SEQ ID NO | SEQUENCE | Description |
|---|---|---|
| 346 | YIQNPDPAVYQLRDSKSSDKSVCLFTDFDSQTNVSQSKDSDVYITDKCVLDMRSMDFKSNSA VAWSNKSDFACANAFNNSIIPEDTFFPSPESSCDVKLVEKSFETDTNLNFQNLSVIGFRILL LKVAGFNLLMTLRLWSS | TCR alpha constant region Homo sapiens (aa) |
| 347 | NIQNPDPAVYQLRDSKSSDKSVCLFTDFDSQTNVSQSKDSDVYITDKCVLDMRSMDFKSNSA VAWSNKSDFACANAFNNSIIPEDTFFPSPESSCDVKLVEKSFETDTNLNFQNLSVIGFRILL LKVAGFNLLMTLRLWSS | TCR alpha constant region Homo sapiens (aa) |
| 348 | DIQNPDPAVYQLRDSKSSDKSVCLFTDFDSQTNVSQSKDSDVYITDKCVLDMRSMDFKSNSA VAWSNKSDFACANAFNNSIIPEDTFFPSPESSCDVKLVEKSFETDTNLNFQNLSVIGFRILL LKVAGFNLLMTLRLWSS | TCR alpha constant region Homo sapiens (aa) |
| 349 | MGIRLLCRVAFCFLAVGLV | Signal sequence |
| 350 | EDLKNVFPPEVAVFEPSEAEISHTQKATLVCLATGFYPDHVELSWWVNGKEVHSGVCTDPQP LKEQPALNDSRYCLSSRLRVSATFWQNPRNHFRCQVQFYGLSENDEWTQDRAKPVTQIVSAE AWGRADCGFTSESYQQGVLSATILYEILLGKATLYAVLVSALVLMAMVKRKDSRG | TCR beta constant region Homo sapiens (aa) |
| 351 | TEDLKNVFPPEVAVFEPSEAEISHTQKATLVCLATGFYPDHVELSWWVNGKEVHSGVCTDPQ PLKEQPALNDSRYCLSSRLRVSATFWQNPRNHFRCQVQFYGLSENDEWTQDRAKPVTQIVSA EAWGRADCGFTSESYQQGVLSATILYEILLGKATLYAVLVSALVLMAMVKRKDSRG | TCR beta constant region Homo sapiens (aa) |
| 352 | LEDLKNVFPPEVAVFEPSEAEISHTQKATLVCLATGFYPDHVELSWWVNGKEVHSGVCTDPQ PLKEQPALNDSRYCLSSRLRVSATFWQNPRNHFRCQVQFYGLSENDEWTQDRAKPVTQIVSA EAWGRADCGFTSESYQQGVLSATILYEILLGKATLYAVLVSALVLMAMVKRKDSRG | TCR beta constant region Homo sapiens (aa) |
| 353 | MSLSSLLKVVTASLWLGPGI | Signal sequence |
| 354 | MKLVTSITVLLSLGIMG | Signal sequence |
| 355 | MGTSLLCWMALCLLGADHADT | Signal sequence |
| 356 | $X_1X_2X_3X_4X_5X_6X_7X_8X_9X_{10}X_{11}X_{12}X_{13}$<br>$X_1$ = A or G;<br>$X_2$ = A, G, P, V, or L;<br>$X_3$ = A, K, N, Y, D, or S;<br>$X_4$ = R, M, I, T, or G;<br>$X_5$ = N, E, L, V, or null;<br>$X_6$ = Y, G, N, D, or null;<br>$X_7$ = S, N, G, or null;<br>$X_8$ = G, N, Y, or null;<br>$X_9$ = D, F, G, N, or null;<br>$X_{10}$ = A, N, Q, or Y;<br>$X_{11}$ = K, R, or N;<br>$X_{12}$ = F, L, or Y;<br>$X_{13}$ = I, M, S, T, V, or Y | TCR E7(11-19) alpha CDR3 consensus |
| 357 | $X_1X_2X_3X_4X_5X_6X_7X_8X_9X_{10}X_{11}X_{12}X_{13}$<br>$X_1$ = A or S;<br>$X_2$ = A, I, S, or Y;<br>$X_3$ = S, T, or R;<br>$X_4$ = G, K, R, L, P, S, or Q;<br>$X_5$ = D, G, T, or W;<br>$X_6$ = A, E, F, R, S, Q, T or V;<br>$X_7$ = A, R, G, Y, or null;<br>$X_8$ = G, N, S, or null;<br>$X_9$ = A, D, G, S, or Y;<br>$X_{10}$ = L, N, or Y;<br>$X_{11}$ = E or V;<br>$X_{12}$ = L or Q;<br>$X_{13}$ = F, Y, or T | TCR E7(11-19) beta CDR3 consensus |
| 358 | gaagatctgaagaacgtcttcccacctgaggtggccgtgttcgagccttctgaggccgagat cagccacacacagaaagccacactcgtgtgtctggccaccggcttctatcccgatcacgtgg aactgtcttggtgggtcaacggcaaagaggtgcacagcggcgtctgtaccgatcctcagcct ctgaaagagcagcccgctctgaacgacagcagatactgcctgagcagcagactgagagtgtc | TCR beta constant region, Homo sapiens (nt) |

| SEQ ID NO | SEQUENCE | Description |
|---|---|---|
| | cgccaccttctggcagaaccccagaaaccacttcagatgccaggtgcagttctacggcctga<br>gcgagaacgatgagtggacccaggatagagccaagcctgtgacacagatcgtgtctgccgaa<br>gcctggggcagagccgattgtggctttaccagcgagagctaccagcagggcgtgctgtctgc<br>cacaatcctgtacgagatcctgctgggcaaagccactctgtacgccgtgctggtgtctgccc<br>tggtgctgatggccatggtcaagcggaaggatagcagaggc | |
| 359 | GAVVSQHPSWVICKSGTSVKIECRSLDFQATTMFWYRQFPKQSLMLMATSNEGSKATYEQGV<br>EKDKFLINHASLTLSTLTVTSAHPEDSSFYICSARSWRGGLEQFFGPGTRLTVLEDLKNVFP<br>PEVAVFEPSEAEISHTQKATLVCLATGFYPDHVELSWWVNGKEVHSGVCTDPQPLKEQPALN<br>DSRYCLSSRLRVSATFWQNPRNHFRCQVQFYGLSENDEWTQDRAKPVTQIVSAEAWGRADCG<br>FTSESYQQGVLSATILYEILLGKATLYAVLVSALVLMAMVKRKDSRG | beta with human constant sequence (aa) |
| 360 | MLLLLLLLGPGSGLGAVVSQHPSWVICKSGTSVKIECRSLDFQATTMFWYRQFPKQSLMLMA<br>TSNEGSKATYEQGVEKDKFLINHASLTLSTLTVTSAHPEDSSFYICSARSWRGGLEQFFGPG<br>TRLTVLEDLKNVFPPEVAVFEPSEAEISHTQKATLVCLATGFYPDHVELSWWVNGKEVHSGV<br>CTDPQPLKEQPALNDSRYCLSSRLRVSATFWQNPRNHFRCQVQFYGLSENDEWTQDRAKPVT<br>QIVSAEAWGRADCGFTSESYQQGVLSATILYEILLGKATLYAVLVSALVLMAMVKRKDSRG | beta with human constant sequence and signal peptide (aa) |
| 361 | atgctgctgcttctgctgcttctggggccaggctccgggcttggtgctgtcgtctctcaaca<br>tccgagctgggttatctgtaagagtggaacctctgtgaagatcgagtgccgttccctggact<br>ttcaggccacaactatgttttggtatcgtcagttcccgaaacagagtctcatgctgatgact<br>acttccaatgagggctccaaggccacatacgagcaaggcgtcgagaaggacaagtttctcat<br>caaccatgcaagcctgaccttgtccactctgacagtgaccagtgcccatcctgaagacagca<br>gcttctacatctgcagtgctagatcttggcgggggggccttgagcagttcttcgggccaggg<br>acacggctcaccgtgctagaagatctgaagaacgtcttcccacctgaggtggccgtgttcga<br>gccttctgaggccgagatcagccacacacagaaagccacactcgtgtgtctggccaccggct<br>tctatcccgatcacgtggaactgtcttggtgggtcaacggcaaagaggtgcacagcggcgtc<br>tgtaccgatcctcagcctctgaaagagcagcccgctctgaacgacagcagatactgcctgag<br>cagcagactgagagtgtccgccaccttctggcagaaccccagaaaccacttcagatgccagg<br>tgcagttctacggcctgagcgagaacgatgagtggacccaggatagagccaagcctgtgaca<br>cagatcgtgtctgccgaagcctggggcagagccgattgtggctttaccagcgagagctacca<br>gcagggcgtgctgtctgccacaatcctgtacgagatcctgctgggcaaagccactctgtacg<br>ccgtgctggtgtctgccctggtgctgatggccatggtcaagcggaaggatagcagaggc | beta with human constant sequence and signal peptide (nt) |
| 362 | MLLLLLLLGPGSGLGAVVSQHPSWVICKSGTSVKIECRSLDFQATTMFWYRQFPKQSLMLMA<br>TSNEGSKATYEQGVEKDKFLINHASLTLSTLTVTSAHPEDSSFYICSARSWRGGLEQFFGPG<br>TRLTVLEDLKNVFPPEVAVFEPSEAEISHTQKATLVCLATGFYPDHVELSWWVNGKEVHSGV<br>CTDPQPLKEQPALNDSRYCLSSRLRVSATFWQNPRNHFRCQVQFYGLSENDEWTQDRAKPVT<br>QIVSAEAWGRADCGFTSESYQQGVLSATILYEILLGKATLYAVLVSALVLMAMVKRKDSRGG<br>SGATNFSLLKQAGDVEENPGPMVLKFSVSILWIQLAWVSTQLLEQSPQFLSIQEGENLTVYC<br>NSSSVFSSLQWYRQEPGEGPVLLVTVVTGGEVKKLKRLTFQFGDARKDSSLHITAAQPGDTG<br>LYLCAGARNFNKFYFGSGTKLNVKPNIQNPDPAVYQLRDSKSSDKSVCLFTDFDSQTNVSQS<br>KDSDVYITDKCVLDMRSMDFKSNSAVAWSNKSDFACANAFNNSIIPEDTFFPSPESSCDVKL<br>VEKSFETDTNLNFQNLSVIGFRILLLKVAGFNLLMTLRLWSS | TCR Full sequence with human constant (aa) |
| 363 | atgctgctgcttctgctgcttctggggccaggctccgggcttggtgctgtcgtctctcaaca<br>tccgagctgggttatctgtaagagtggaacctctgtgaagatcgagtgccgttccctggact<br>ttcaggccacaactatgttttggtatcgtcagttcccgaaacagagtctcatgctgatggca<br>acttccaatgagggctccaaggccacatacgagcaaggcgtcgagaaggacaagtttctcat<br>caaccatgcaagcctgaccttgtccactctgacagtgaccagtgcccatcctgaagacagca<br>gcttctacatctgcagtgctagatcttggcgggggggccttgagcagttcttcgggccaggg<br>acacggctcaccgtgctagaagatctgaagaacgtcttcccacctgaggtggccgtgttcga<br>gccttctgaggccgagatcagccacacacagaaagccacactcgtgtgtctggccaccggct<br>tctatcccgatcacgtggaactgtcttggtgggtcaacggcaaagaggtgcacagcggcgtc<br>tgtaccgatcctcagcctctgaaagagcagcccgctctgaacgacagcagatactgcctgag<br>cagcagactgagagtgtccgccaccttctggcagaaccccagaaaccacttcagatgccagg<br>tgcagttctacggcctgagcgagaacgatgagtggacccaggatagagccaagcctgtgaca<br>cagatcgtgtctgccgaagcctggggcagagccgattgtggctttaccagcgagagctacca<br>gcagggcgtgctgtctgccacaatcctgtacgagatcctgctgggcaaagccactctgtacg<br>ccgtgctggtgtctgccctggtgctgatggccatggtcaagcggaaggatagcagaggcgga<br>agcggcgccacaaactctcactgctgaaacaggctggcgacgtggaggagaatcctggccc<br>aatggtcctgaaattctccgtgtccattctttggattcagttggcatgggtgagcacccagc<br>tgctggagagagccctcagtttctaagcatccaagagggagaaaatctcactgtgtactgc<br>aactcctcaagtgtttttttccagcttacaatgtacagacaggagcctggggaaggtcctgt<br>cctcctggtgacagtagttacggtggagaagtgaagaagctgaagagactaacctttcagt<br>ttggtgatgcaaagaaaggacagttctctccacatcactgcagcccagcctggtgatacagg<br>ctctacctctgtgcaggagctcgcaacttcaacaaattttactttggatctgggaccaaact<br>caatgtaaaaccaaatatccagaatccggacccgcggtatatcaactgcgcgactcaaaat<br>catccgataagagtgtctgtttgtttactgacttcgacagtcaaactaatgtctctcagagc<br>aaagattccgatgtctacatcactgacaagtgcgttctggatatgcggagcatggattttaa<br>gtccaactccgccgtagcctggtccaacaagtcagactttgcctgtgcaaatgctttcaaca | TCR Full sequence with human constant (nt) |

| SEQ ID NO | SEQUENCE | Description |
|---|---|---|
| | actcaattatccctgaggacactttctttccttcaccggagtcctcatgcgatgttaaactg gtcgaaaatcttttgagacggatacgaacctcaacttccaaaatttgagcgttattggctt taggattctgcttctcaaggttgcggggttcaatctcctgatgacgttgcggctttggagca gc | |
| 364 | ATGGCCAACTCTGCTATGGACACCAGAGTACTCTGCTGTGCGGTCATCTGTCTTCTGGGGGC AGGTCTCTCAAATGCCGGCGTCATGCAGAACCCAAGACACCTGGTCAGGAGGAGGGGACAGG AGGCAAGACTGAGATGCAGCCCAATGAAAGGACACAGTCATGTTTACTGGTATCGGCAGCTC CCAGAGGAAGGTCTGAAATTCATGGTTTATCTCCAGAAAGAAAATATCATAGATGAGTCAGG AATGCCAAAGGAACGATTTTCTGCTGAATTTCCCAAAGAGGGCCCCAGCATCCTGAGGATCC AGCAGGTAGTGCGAGGAGATTCGGCAGCTTATTTCTGTGCCAGCTCACCAGACGAAAGCAGG GATAGCAATCAGCCCCAGCATTTTGGTGATGGGACTCGACTCTCCATCCTAgaggacctgaa taaggtgttccccctgaggtggccgtgtttgagccaagcgaggccgagatctcccacaccc agaaggccaccctggtgtgcctggcaaccggcttctttcccgatcacgtggagctgtcctgg tgggtgaacggcaaggaggtgcactctggcgtgtgcacagacccacagcccctgaaggagca gcctgccctgaatgattcccgctattgtctgtcctctcggctgagagtgtctgccaccttt ggcagaacccacggaatcacttcagatgccaggtgcagttttacggcctgtctgagaacgac gagtggacccaggatcgggccaagcctgtgacacagatcgtgagcgcggaagcatggggcag agccgactgtggcttcaccagcgtgtcctatcagcagggcgtgctgtccgccaccatcctgt acgagatcctgctgggcaaggccacactgtatgccgtgctggtgtctgccctggtgctgatg gccatggtgaagagaaaagacttctaaggctccggagcaaccaatttcagcctgctgaagca ggccggcgatgtggaggagaatcctggcccaATGGCTCAGGAACTGGGAATGCAGTGCCAGG CTCGTGGTATCCTGCAGCAGATGTGGGGAGTTTTCCTTCTTTATGTTTCCATGAAGATGGGA GGCACTACAGGACAAAACATTGACCAGCCCACTGAGATGACAGCTGAGGAAGGTGCCATTGT CCAGATCAACTGCACGTACCAGACATCTGGGTTCAACGGGCTGTTCTGGTACCAGCAACATG CTGGCGAAGCACCCACATTTCTGTCTTACAATGTTCTGGATGGTTTGGAGGAGAAAGGTCGT TTTTCTTCATTCCTTAGTCGGTCTAAAGGGTACAGTTACCTCCTTTTGAAGGAGCTCCAGAT GAAAGACTCTGCCTCTTACCTCTGTGCTGTGAGAGATTGGGGATATGGTGGTGCTACAAACA AGCTCATCTTTGGAACTGGCACTCTGCTTGCTGTCCAGCCAAATATCCAGAATCCGGACCcc gcggtatatcaactgcgcgactcaaaatcatccgataagagtgtctgtttgtttactgactt cgacagtcaaactaatgtctctcagagcaaagattccgatgtctacatcactgacaagtgcg ttctggatatgcggagcatggattttaagtccaactccgccgtagcctggtccaacaagtca gactttgcctgtgcaaatgctttcaacaactcaattatccctgaggacactttctttccttc accggagtcctcatgcgatgttaaactggtcgaaaatcttttgagacggatacgaacctca acttccaaaatttgagcgttattggctttaggattctgcttctcaaggttgcggggttcaat ctcctgatgacgttgcggctttggagcagctaa | TCR 56 Native full sequence with human constant (nt) |
| 365 | ATGCTGCTGCTTCTGCTGCTTCTGGGGCCAGGCTCCGGGCTTGGTGCTGTCGTCTCTCAACA TCCGAGCTGGGTTATCTGTAAGAGTGGAACCTCTGTGAAGATCGAGTGCCGTTCCCTGGACT TTCAAGCCACAACTATGTTTTGGTATCGTCAGTTCCCGAAACAGAGTCTCATGCTGATGGCA ACTTCCAATGAGGGCTCCAAGGCCACATACGAGCAAGGCGTCGAGAAGGACAAGTTTCTCAT CAACCATGCAAGCCTGACCTTGTCCACTCTGACAGTGACCAGTGCCCATCCTGAAGACAGCA GCTTCTACATCTGCAGTGCTAGATCTTGGCGGGGGGGCCTTGAGCAGTTCTTCGGGCCAGGG ACACGGCTCACCGTGCTAGAAGATCTGAAGAACGTCTTCCCACCTGAGGTGGCCGTGTTCGA GCCTTCTGAGGCCGAGATCAGCCACACACAGAAAGCCACACTCGTGTGCTTGGCCACCGGCT TCTATCCCGATCACGTGGAACTGTCTTGGTGGGTCAACGGCAAAGAGGTCCACAGCGGCGTC TGTACCGATCCTCAGCCTCTGAAAGAGCAGCCCGCTCTGAACGACAGCAGATACTGCCTGAG CAGCAGACTGAGAGTGTCCGCCACCTTCTGGCAGAACCCCAGAAACCACTTCAGATGCCAGG TGCAGTTCTACGGCCTGAGCGAGAACGATGAGTGGACCCAGGATAGAGCCAAGCCTGTGACA CAGATCGTGTCTGCCGAAGCCTGGGGCAGAGCCGATTGTGGCTTTACCAGCGAGAGCTACCA GCAGGGCGTGCTGTCTGCCACAATCCTGTACGAGATCCTGCTGGGCAAAGCCACTCTGTACG CCGTGCTGGTGTCTGCCCTGGTGCTGATGGCCATGGTCAAGCGGAAGGATAGCAGAGGCGGA AGCGGCGCCACAAACTTCTCACTGCTGAAACAGGCTGGCGACGTGGAGGAGAATCTCGGCCC AATGGTCCTGAAATTCTCCGTGTCCATTCTTTGGATTCAGTTGGCATGGGTCAGCACCCAGC TGCTGGAGCAGAGCCCTCAGTTTCTAAGCATCCAAGGGGAGAAAATCTCACTGTGTACTGC AACTCCTCAAGTGTTTTTCCTCCTTACAATGGTATCGACAGGAGCCTGGGGAAGGTCCTGT CCTCCTGGTGACAGTAGTTACGGGTGGAGAAGTGAAGAAGCTGAAGAGACTAACCTTTCAGT TTGGTGATGCAAGAAAGGACAGTTCTCTCCACATCACTGCAGCCCAGCCTGGTGATACAGGC CTCTACCTCTGTGCCGGAGCTCGCAACTTCAACAAATTTTACTTTGGATCTGGGACCAAACT CAATGTGAAACCAAATATCCAGAATCCGGACCCCGCGGTATATCAACTGCGCGACTCAAAAT CATCCGATAAGAGTGTCTGTTTGTTTACTGACTTCGACAGTCAAACTAATGTCTCTCAGAGC AAAGATTCCGATGTCTACATCACTGACAAATGCGTTCTGGATATGCGGAGCATGGATTTTAA GTCCAACTCCGCCGTAGCCTGGTCCAACAAGTCAGACTTTGCCTGTGCAAATGCTTTCAACA ACTCAATTATCCCTGAGGACACTTTCTTTCCTTCACCGGAGTCCTCATGCGATGTTAAACTG GTCGAAAATCTTTTGAGACGGATACGAACCTCAACTTCCAAAATTTGAGCGTTATTGGCTT TCGGATTCTGCTTCTCAAAGTTGCGGGGTTCAATCTCCTGATGACGTTGCGGCTTTGGAGCA GCTAA | TCR 57 Full sequence with human constant (nt) |
| 366 | ccgcggtatatcaactgcgcgactcaaaatcatccgataagagtgtctgtttgtttactgac ttcgacagtcaaactaatgtctctcagagcaaagattccgatgtctacatcactgacaagtg cgttctggatatgcggagcatggattttaagtccaactccgccgtagcctggtccaacaagt cagactttgcctgtgcaaatgctttcaacaactcaattatccctgaggacactttctttcct tcaccggagtcctcatgcgatgttaaactggtcgaaaatcttttgagacggatacgaacct | TCR alpha constant region, Homo sapiens (nt) |

SEQUENCE TABLE

| SEQ ID NO | SEQUENCE | Description |
|---|---|---|
| | caacttccaaaatttgagcgttattggctttaggattctgcttctcaaggttgcggggttca<br>atctcctgatgacgttgcggctttggagcagctaa | |
| 367 | CCGCGGTATATCAACTGCGCGACTCAAAATCATCCGATAAGAGTGTCTGTTTGTTTACTGAC<br>TTCGACAGTCAAACTAATGTCTCTCAGAGCAAAGATTCCGATGTCTACATCACTGACAAATG<br>CGTTCTGGATATGCGGAGCATGATTTTAAGTCCAACTCCGCCGTAGCCTGGTCCAACAAGT<br>CAGACTTTGCCTGTGCAAATGCTTTCAACAACTCAATTATCCCTGAGGACACTTTCTTTCCT<br>TCACCGGAGTCCTCATGCGATGTTAAACTGGTCGAAAAATCTTTTGAGACGGATACGAACCT<br>CAACTTCCAAAATTTGAGCGTTATTGGCTTTCGGATTCTGCTTCTCAAAGTTGCGGGGTTCA<br>ATCTCCTGATGACGTTGCGGCTTTGGAGCAGCTAA | TCR alpha constant region, Homo sapiens (nt) |
| 368 | GGAAGCGGCGCCACAAACTTCTCACTGCTGAAACAGGCTGGCGACGTGGAGGAGAATCCTGG<br>CCCA | P2A Artificial (nt) |
| 369 | NAGVMQNPRHLVRRGQEARLRCSPMKGHSHVYWYRQLPEEGLKFMVYLQKENIIDESGMPK<br>ERFSAEFPKEGPSILRIQQVVRGDSAAYFCASSPDESRDSNQPQHFGDGTRLSILEDLKNVF<br>PPEVAVFEPSEAEISHTQKATLVCLATGFYPDHVELSWWVNGKEVHSGVCTDPQPLKEQPAL<br>NDSRYCLSSRLRVSATFWQNPRNHFRCQVQFYGLSENDEWTQDRAKPVTQIVSAEAWGRADC<br>GFTSESYQQGVLSATILYEILLGKATLYAVLVSALVLMAMVKRKDSRG | TCR 56 beta with human constant sequence (aa) |
| 370 | EPEVTQTPSHQVTQMGQEVILRCVPISNHLYFYWYRQILGQKVEFLVSFYNNEISEKSEIFD<br>DQFSVERPDGSNFTLKIRSTKLEDSAMYFCASTPRSSYEQYFGPGTRLTVTEDLKNVFPPEV<br>AVFEPSEAEISHTQKATLVCLATGFYPDHVELSWWVNGKEVHSGVCTDPQPLKEQPALNDSR<br>YCLSSRLRVSATFWQNPRNHFRCQVQFYGLSENDEWTQDRAKPVTQIVSAEAWGRADCGFTS<br>ESYQQGVLSATILYEILLGKATLYAVLVSALVLMAMVKRKDSRG | TCR 58 beta with human constant sequence (aa) |
| 371 | EPEVTQTPSHQVTQMGQEVILRCVPISNHLYFYWYRQILGQKVEFLVSFYNNEISEKSEIFD<br>DQFSVERPDGSNFTLKIRSTKLEDSAMYFCAYSGRASYEQYFGPGTRLTVTEDLKNVFPPEV<br>AVFEPSEAEISHTQKATLVCLATGFYPDHVELSWWVNGKEVHSGVCTDPQPLKEQPALNDSR<br>YCLSSRLRVSATFWQNPRNHFRCQVQFYGLSENDEWTQDRAKPVTQIVSAEAWGRADCGFTS<br>ESYQQGVLSATILYEILLGKATLYAVLVSALVLMAMVKRKDSRG | TCR 59 beta with human constant sequence (aa) |
| 372 | EPEVTQTPSHQVTQMGQEVILRCVPISNHLYFYWYRQILGQKVEFLVSFYNNEISEKSEIFD<br>DQFSVERPDGSNFTLKIRSTKLEDSAMYFCAISRTVSYEQYFGPGTRLTVTEDLKNVFPPEV<br>AVFEPSEAEISHTQKATLVCLATGFYPDHVELSWWVNGKEVHSGVCTDPQPLKEQPALNDSR<br>YCLSSRLRVSATFWQNPRNHFRCQVQFYGLSENDEWTQDRAKPVTQIVSAEAWGRADCGFTS<br>ESYQQGVLSATILYEILLGKATLYAVLVSALVLMAMVKRKDSRG | TCR 60 beta with human constant sequence (aa) |
| 373 | EPEVTQTPSHQVTQMGQEVILRCVPISNHLYFYWYRQILGQKVEFLVSFYNNEISEKSEIFD<br>DQFSVERPDGSNFTLKIRSTKLEDSAMYFCASTKRFSYEQYFGPGTRLTVTEDLKNVFPPEV<br>AVFEPSEAEISHTQKATLVCLATGFYPDHVELSWWVNGKEVHSGVCTDPQPLKEQPALNDSR<br>YCLSSRLRVSATFWQNPRNHFRCQVQFYGLSENDEWTQDRAKPVTQIVSAEAWGRADCGFTS<br>ESYQQGVLSATILYEILLGKATLYAVLVSALVLMAMVKRKDSRG | TCR 61 beta with human constant sequence (aa) |
| 374 | EAGVAQSPRYKIIEKRQSVAFWCNPISGHATLYWYQQILGQGPKLLIQFQNNGVVDDSQLPK<br>DRFSAERLKGVDSTLKIQPAKLEDSAVYLCASSLDTRGSSYNEQFFGPGTRLTVLEDLKNVF<br>PPEVAVFEPSEAEISHTQKATLVCLATGFYPDHVELSWWVNGKEVHSGVCTDPQPLKEQPAL<br>NDSRYCLSSRLRVSATFWQNPRNHFRCQVQFYGLSENDEWTQDRAKPVTQIVSAEAWGRADC<br>GFTSESYQQGVLSATILYEILLGKATLYAVLVSALVLMAMVKRKDSRG | TCR 62 beta with human constant sequence (aa) |
| 375 | GAGVSQSPRYKVAKRGQDVALRCDPISGHVSLFWYQQALGQGPEFLTYFQNEAQLDKSGLPS<br>DRFFAERPEGSVSTLKIQRTQQEDSAVYLCASRPRQGYNDNEQFFGPGTRLTVLEDLKNVFP<br>PEVAVFEPSEAEISHTQKATLVCLATGFYPDHVELSWWVNGKEVHSGVCTDPQPLKEQPALN<br>DSRYCLSSRLRVSATFWQNPRNHFRCQVQFYGLSENDEWTQDRAKPVTQIVSAEAWGRADCG<br>FTSESYQQGVLSATILYEILLGKATLYAVLVSALVLMAMVKRKDSRG | TCR 63 beta with human constant sequence (aa) |
| 376 | DTAVSQTPKYLVTQMGNDKSIKCEQNLGHDTMYWYKQDSKKFLKIMFSYNNKELIINETVPN<br>RFSPKSPDKAHLNLHINSLELGDSAVYFCASSQGEAGANVLTFGAGSRLTVLEDLKNVFPPE<br>VAVFEPSEAEISHTQKATLVCLATGFYPDHVELSWWVNGKEVHSGVCTDPQPLKEQPALNDS<br>RYCLSSRLRVSATFWQNPRNHFRCQVQFYGLSENDEWTQDRAKPVTQIVSAEAWGRADCGFT<br>SESYQQGVLSATILYEILLGKATLYAVLVSALVLMAMVKRKDSRG | TCR 64 beta with human constant sequence (aa) |
| 377 | DVKVTQSSRYLVKRTGEKVFLECVQDMDHENMFWYRQDPGLGLRLIYFSYDVKMKEKGDIPE<br>GYSVSREKKERFSLILESASTNQTSMYLCASSLWGRRNTGELFFGEGSRLTVLEDLKNVFPP<br>EVAVFEPSEAEISHTQKATLVCLATGFYPDHVELSWWVNGKEVHSGVCTDPQPLKEQPALND<br>SRYCLSSRLRVSATFWQNPRNHFRCQVQFYGLSENDEWTQDRAKPVTQIVSAEAWGRADCGF<br>TSESYQQGVLSATILYEILLGKATLYAVLVSALVLMAMVKRKDSRG | TCR 65 beta with human constant sequence (aa) |

SEQUENCE TABLE

| SEQ ID NO | SEQUENCE | Description |
|---|---|---|
| 378 | MANSAMDTRVLCCAVICLLGAGLSNAGVMQNPRHLVRRRGQEARLRCSPMKGHSHVYWYRQL PEEGLKFMVYLQKENIIDESGMPKERFSAEFPKEGPSILRIQQVVRGDSAAYFCASSPDESR DSNQPQHFGDGTRLSILEDLKNVFPPEVAVFEPSEAEISHTQKATLVCLATGFYPDHVELSW WVNGKEVHSGVCTDPQPLKEQPALNDSRYCLSSRLRVSATFWQNPRNHFRCQVQFYGLSEND EWTQDRAKPVTQIVSAEAWGRADCGFTSESYQQGVLSATILYEILLGKATLYAVLVSALVLM AMVKRKDSRG | TCR 56 beta with human constant sequence and signal peptide (aa) |
| 379 | MDTWLVCWAIFSLLKAGLTEPEVTQTPSHQVTQMGQEVILRCVPISNHLYFYWYRQILGQKV EFLVSFYNNEISEKSEIFDDQFSVERPDGSNFTLKIRSTKLEDSAMYFCASTPRSSYEQYFG PGTRLTVTEDLKNVFPPEVAVFEPSEAEISHTQKATLVCLATGFYPDHVELSWWVNGKEVHS GVCTDPQPLKEQPALNDSRYCLSSRLRVSATFWQNPRNHFRCQVQFYGLSENDEWTQDRAKP VTQIVSAEAWGRADCGFTSESYQQGVLSATILYEILLGKATLYAVLVSALVLMAMVKRKDSR G | TCR 58 beta with human constant sequence and signal peptide (aa) |
| 380 | MDTWLVCWAIFSLLKAGLTEPEVTQTPSHQVTQMGQEVILRCVPISNHLYFYWYRQILGQKV EFLVSFYNNEISEKSEIFDDQFSVERPDGSNFTLKIRSTKLEDSAMYFCAYSGRASYEQYFG PGTRLTVTEDLKNVFPPEVAVFEPSEAEISHTQKATLVCLATGFYPDHVELSWWVNGKEVHS GVCTDPQPLKEQPALNDSRYCLSSRLRVSATFWQNPRNHFRCQVQFYGLSENDEWTQDRAKP VTQIVSAEAWGRADCGFTSESYQQGVLSATILYEILLGKATLYAVLVSALVLMAMVKRKDSR G | TCR 59 beta with human constant sequence and signal peptide (aa) |
| 381 | MDTWLVCWAIFSLLKAGLTEPEVTQTPSHQVTQMGQEVILRCVPISNHLYFYWYRQILGQKV EFLVSFYNNEISEKSEIFDDQFSVERPDGSNFTLKIRSTKLEDSAMYFCAISRTVSYEQYFG PGTRLTVTEDLKNVFPPEVAVFEPSEAEISHTQKATLVCLATGFYPDHVELSWWVNGKEVHS GVCTDPQPLKEQPALNDSRYCLSSRLRVSATFWQNPRNHFRCQVQFYGLSENDEWTQDRAKP VTQIVSAEAWGRADCGFTSESYQQGVLSATILYEILLGKATLYAVLVSALVLMAMVKRKDSR G | TCR 60 beta with human constant sequence and signal peptide (aa) |
| 382 | MDTWLVCWAIFSLLKAGLTEPEVTQTPSHQVTQMGQEVILRCVPISNHLYFYWYRQILGQKV EFLVSFYNNEISEKSEIFDDQFSVERPDGSNFTLKIRSTKLEDSAMYFCASTKRFSYEQYFG PGTRLTVTEDLKNVFPPEVAVFEPSEAEISHTQKATLVCLATGFYPDHVELSWWVNGKEVHS GVCTDPQPLKEQPALNDSRYCLSSRLRVSATFWQNPRNHFRCQVQFYGLSENDEWTQDRAKP VTQIVSAEAWGRADCGFTSESYQQGVLSATILYEILLGKATLYAVLVSALVLMAMVKRKDSR G | TCR 61 beta with human constant sequence and signal peptide (aa) |
| 383 | MGTRLLCWAALCLLGAELTEAGVAQSPRYKIIEKRQSVAFWCNPISGHATLYWYQQILGQGP KLLIQFQNNGVVDDSQLPKDRFSAERLKGVDSTLKIQPAKLEDSAVYLCASSLDTRGSSYNE QFFGPGTRLTVLEDLKNVFPPEVAVFEPSEAEISHTQKATLVCLATGFYPDHVELSWWVNGK EVHSGVCTDPQPLKEQPALNDSRYCLSSRLRVSATFWQNPRNHFRCQVQFYGLSENDEWTQD RAKPVTQIVSAEAWGRADCGFTSESYQQGVLSATILYEILLGKATLYAVLVSALVLMAMVKR KDSRG | TCR 62 beta with human constant sequence and signal peptide (aa) |
| 384 | MGTRLLCWVVLGFLGTDHTGAGVSQSPRYKVAKRGQDVALRCDPISGHVSLFWYQQALGQGP EFLTYFQNEAQLDKSGLPSDRFFAERPEGSVSTLKIQRTQQEDSAVYLCASRPRQGYNDNEQ FFGPGTRLTVLEDLKNVFPPEVAVFEPSEAEISHTQKATLVCLATGFYPDHVELSWWVNGKE VHSGVCTDPQPLKEQPALNDSRYCLSSRLRVSATFWQNPRNHFRCQVQFYGLSENDEWTQDR AKPVTQIVSAEAWGRADCGFTSESYQQGVLSATILYEILLGKATLYAVLVSALVLMAMVKRK DSRG | TCR 63 beta with human constant sequence and signal peptide (aa) |
| 385 | MGCRLLCCVVFCLLQAGPLDTAVSQTPKYLVTQMGNDKSIKCEQNLGHDTMYWYKQDSKKFL KIMFSYNNKELIINETVPNRFSPKSPDKAHLNLHINSLELGDSAVYFCASSQGEAGANVLTF GAGSRLTVLEDLKNVFPPEVAVFEPSEAEISHTQKATLVCLATGFYPDHVELSWWVNGKEVH SGVCTDPQPLKEQPALNDSRYCLSSRLRVSATFWQNPRNHFRCQVQFYGLSENDEWTQDRAK PVTQIVSAEAWGRADCGFTSESYQQGVLSATILYEILLGKATLYAVLVSALVLMAMVKRKDS RG | TCR 64 beta with human constant sequence and signal peptide (aa) |
| 386 | MGIRLLCRVAFCFLAVGLVDVKVTQSSRYLVKRTGEKVFLECVQDMDHENMFWYRQDPGLGL RLIYFSYDVKMKEKGDIPEGYSVSREKKERFSLILESASTNQTSMYLCASSLWGRRNTGELF FGEGSRLTVLEDLKNVFPPEVAVFEPSEAEISHTQKATLVCLATGFYPDHVELSWWVNGKEV HSGVCTDPQPLKEQPALNDSRYCLSSRLRVSATFWQNPRNHFRCQVQFYGLSENDEWTQDRA KPVTQIVSAEAWGRADCGFTSESYQQGVLSATILYEILLGKATLYAVLVSALVLMAMVKRKD SPG | TCR 65 beta with human constant sequence and signal peptide (aa) |
| 387 | ATGGCCAACTCTGCTATGGACACCAGAGTACTCTGCTGTGCGGTCATCTGTCTTCTGGGGGC AGGTCTCTCAAATGCCGGCGTCATGCAGAACCCAAGACACCTGGTCAGGAGGAGGGGACAGG AGGCAAGACTGAGATGCAGCCCAATGAAAGGACACAGTCATGTTTACTGGTATCGGCAGCTC CCAGAGGAAGGTCTGAAATTCATGGTTTATCTCCAGAAAGAAAATATCATAGATGAGTCAGG AATGCCAAAGGAACGATTTTCTGCTGAATTTCCCAAAGAGGGCCCAGCATCCTGAGGATCC AGCAGGTAGTGCGAGGAGATTCGGCAGCTTATTTCTGTGCCAGCTCACCAGACGAAAGCAGG GATAGCAATCAGCCCCAGCATTTTGGTGATGGGACTCGACTCTCCATCCTAgaggacctgaa taaggtgttcccccctgaggtggccgtgtttgagccaagcgaggccgagatctcccacaccc agaaggccaccctggtgtgcctggcaaccggcttctttcccgatcacgtggagctgtcctgg | TCR 56 Native full sequence with human constant (nt) |

SEQUENCE TABLE

| SEQ ID NO | SEQUENCE | Description |
|---|---|---|
| | tgggtgaacggcaaggaggtgcactctggcgtgtgcacagacccacagcccctgaaggagca gcctgccctgaatgattcccgctattgtctgtcctctcggctgagagtgtctgccaccttt ggcagaacccacggaatcacttcagatgccaggtgcagttttacggcctgtctgagaacgac gagtggacccaggatcgggccaagcctgtgacacagatcgtgagcgcggaagcatggggcag agccgactgtggcttcaccagcgtgtcctatcagcagggcgtgctgtccgccaccatcctgt acgagatcctgctgggcaaggccacactgtatgccgtgctggtgtctgccctggtgctgatg gccatggtgaagagaaaagacttcggctccggagcaaccaatttcagcctgctgaagcaggc cggcgatgtggaggagaatcctggcccaATGGCTCAGGAACTGGGAATGCAGTGCCAGGCTC GTGGTATCCTGCAGCAGATGTGGGGAGTTTTCCTTCTTTATGTTTCCATGAAGATGGGAGGC ACTACAGGACAAAACATTGACCAGCCCACTGAGATGACAGCTACGGAAGGTGCCATTGTCCA GATCAACTGCACGTACCAGACATCTGGGTTCAACGGGCTGTTCTGGTACCAGCAACATGCTG GCGAAGCACCCACATTTCTGTCTTACAATGTTCTGGATGGTTTGGAGGAGAAAGGTCGTTTT TCTTCATTCCTTAGTCGGTCTAAAGGGTACAGTTACCTCCTTTTGAAGGAGCTCCAGATGAA AGACTCTGCCTCTTACCTCTGTGCTGTGAGAGATTGGGGATATGGTGGTGCTACAAACAAGC TCATCTTTGGAACTGGCACTCTGCTTGCTGTCCAGCCAAATATCCAGAATCCGGACCccgcg gtatatcaactgcgcgactcaaaatcatccgataagagtgtctgttttgtttactgacttcga cagtcaaactaatgtctctcagagcaaagattccgatgtctacatcactgacaagtgcgttc tggatatgcggagcatggattttaagtccaactccgccgtagcctggtccaacaagtcagac tttgcctgtgcaaatgctttcaacaactcaattatccctgaggacactttcttccttcacc ggagtcctcatgcgatgttaaactggtcgaaaaatcttttgagacggatacgaacctcaact tccaaaatttgagcgttattggctttaggattctgcttctcaaggttgcggggttcaatctc ctgatgacgttgcggctttggagcagctaa | |
| 388 | atgggacccatggccaatagcgccatggataccagagtgctgtgctgcgccgtgatctgtct gcttggagccgactgtctaatgccggcgtgatgcagaacccagacacctcgttcggagaa gaggccaagaggccagactgagatgcagccctatgaagggccacagccacgtgtactggtac agacagctgcctgaagagggcctgaagttcatggtgtacctgcagaaagagaacatcatcga cgagagcggcatgcccaaagagcggttctctgccgagtttcccaaagagggccccagcatcc tgagaatccagcaggttgtgcgggagatagcgccgcctacttttgtgcagctctcccgat gagagccgggactctaatcagcctcagcactttggcgacggcaccaggctgtctattctcga ggacctgaataaggtgttccccctgaggtggccgtgtttgagccaagcgaggccgagatct cccacacccagaaggccaccctggtgtgcctggcaaccggcttcttccccgatcacgtggag ctgtcctggtgggtgaacggcaaggaggtgcactctggcgtgtgcacagacccacagcccct gaaggagcagcctgccctgaatgattcccgctattgtctgtcctctcggctgagagtgtctg ccaccttttggcagaacccacggaatcacttcagatgccaggtgcagtttacggcctgtct gagaacgacgagtggacccaggatcgggccaagcctgtgacacagatcgtgagcgcggaagc atgggcagagccgactgtggcttcaccagcgtgtcctatcagcagggcgtgctgtccgcca ccatcctgtacgagatcctgctgggcaaggccacactgtatgccgtgctggtgtctgccctg gtgctgatggccatggtgaagagaaaagacttcggctccggagcaaccaatttcagcctgct gaagcaggccggcgatgtggaggagaatcctggcccaATGGCTCAAGAGCTGGGCATGCAGT GTCAGGCCAGAGGAATCCTGCAGCAGATGTGGGGAGTGTTCCTGCTGTACGTGTCCATGAAG ATGGGCGGCACCACCGGCCAGAACATCGATCAGCCTACAGAGATGACCGCCACCGAGGGCGC CATCGTGCAGATCAATTGCACCTACCAGACCAGCGGCTTCAACGGCCTGTTCTGGTATCAGC AGCATGCCGGCGAGGCCCTACCTTCCTGAGCTACAATGTGCTGGACGGCCTGGAAGAGAAG GGCAGATTCAGCAGCTTCCTGTCCAGAAGCAAGGGCTACAGCTACCTGCTGCTGAAAGAACT GCAGATGAAGGACAGCGCCTCCTACCTGTGCGCCGTTAGAGATTGGGGATACGGCGGAGCCA CCAACAAGCTGATCTTTGGCACAGGCACACTGCTGGCCGTGCAGCCTAATATCCAGAATCCG GACCccgcggtatatcaactgcgcgactcaaaatcatccgataagagtgtctgttttgttac tgacttcgacagtcaaactaatgtctctcagagcaaagattccgatgtctacatcactgaca gtgcgttctggatatgcggagcatggattttaagtccaactccgccgtagcctggtccaac aagtcagactttgcctgtgcaaatgctttcaacaactcaattatccctgaggacactttctt tccttcaccggagtcctcatgcgatgttaaactggtcgaaaaatcttttgagacggatacga acctcaacttccaaaatttgagcgttattggctttaggattctgcttctcaaggttgcgggg ttcaatctcctgatgacgttgcggctttggagcagctaa | TCR 56 Codon-optimized full sequence with human constant (nt) |
| 389 | ATGCTGCTGCTTCTGCTGCTTCTGGGGCCAGGCTCCGGGCTTGGTGCTGTCGTCTCTCAACA TCCGAGCTGGGTTATCTGTAAGAGTGGAACCTCTGTGAAGATCCAGTGCCGTTCCCTGGACT TTCAGGCCACAACTATGTTTTGGTATCGTCAGTTCCCGAAACAGAGTCTCATGCTGATGGCA ACTTCCAATGAGGGCTCCAAGGCCACATACGAGCAAGGCGTCGAGAAGGACAAGTTTCTCAT CAACCATGCAAGCCTGACCTTGTCCACTCTGACAGTGACCAGTGCCCATCCTGAAGACAGCA GCTTCTACATCTGCAGTGCTAGATCTTGGCGGGGGGCCTTGAGCAGTTCTTCGGGCCAGGG ACACGGCTCACCGTGCTAgaggacctgaataaggtgttccccctggaggtggccgtgtttga gccaagcgaggccgagatctcccacacccagaaggccaccctggtgtgcctggcaaccggct tctttcccgatcacgtggagctgtcctggtgggtgaacggcaaggaggtgcactctggcgtg tgcacagacccacagcccctgaaggagcagcctgccctgaatgattcccgctattgtctgtc ctctcggctgagagtgtctgccaccttttggcagaacccacggaatcacttcagatgccagg tgcagttttacggcctgtctgagaacgacgagtggacccaggatcgggccaagcctgtgaca cagatcgtgagcgcggaagcatggggcagagccgactgtggcttcaccagcgtgtcctatca gcagggcgtgctgtccgccaccatcctgtacgagatcctgctgggcaaggccacactgtatg ccgtgctggtgtctgccctggtgctgatggccatggtgaagagaaaagacttcggctccgga gcaaccaatttcagcctgctgaagcaggccggcgatgtggaggagaatcctggcccaATGGT CCTGAAATTCTCCGTGTCCATTCTTTGGATTCAGTTGGCATGGGTGAGCACCCAGCTGCTGG AGCAGAGCCCTCAGTTTCTAAGCATCCAAGAGGGAGAAAATCTCACTGTGTACTGCAACTCC | TCR 57 Native full sequence with human constant (nt) |

SEQUENCE TABLE

| SEQ ID NO | SEQUENCE | Description |
|---|---|---|
| | TCAAGTGTTTTTTCCAGCTTACAATGGTACAGACAGGAGCCTGGGGAAGGTCCTGTCCTCCT GGTGACAGTAGTTACGGGTGGAGAAGTGAAGAAGCTGAAGAGACTAACCTTTCAGTTTGGTG ATGCAAGAAAGGACAGTTCTCTCCACATCACTGCaGCCCAGCCTGGTGATACAGGCCTCTAC CTCTGTGCAGGAGCTCGCAACTTCAACAAATTTTACTTTGGATCTGGGACCAAACTCAATGT AAAACCAAATATCCAGAATCCGGACCccgcggtatatcaactgcgcgactcaaaatcatccg ataagagtgtctgtttgtttactgacttcgacagtcaaactaatgtctctcagagcaaagat tccgatgtctacatcactgacaagtgcgttctggatatgcggagcatggatttaagtccaa ctccgccgtagcctggtccaacaagtcagactttgcctgtgcaaatgctttcaacaactcaa ttatccctgaggacacttcttcctttcaccggagtcctcatgcgatgttaaactggtcgaa aaatcttttgagacggatacgaacctcaacttccaaaatttgagcgttattggctttaggat tctgcttctcaaggttgcggggttcaatctcctgatgacgttgcggctttggagcagctaa | |
| 390 | ATGCTCCTGCTGCTTCTGCTCCTCGGGCCCGGCAGCGGTCTCGGCGCCGTCGTGTCGCAGCA CCCGTCGTGGGTGATTTGCAAGAGCGGAACGAGCGTGAAGATCGAGTGCCGCTCGCTCGACT TCCAGGCCACAACCATGTTCTGGTACCGCCAGTTTCCCAAGCAGAGCCTCATGCTGATGGCC ACAAGCAATGAAGGCAGCAAGGCCACTTATGAACAGGGCGTGGAGAAGGACAAGTTTCTGAT CAACCACGCCTCCCTGACCCTGTCCACCCTCACTGTGACCAGCGCCCACCCTGAGGACAGCA GCTTCTACATCTGCAGCGCCCGCAGCTGGAGGGGCGGCCTGGAGCAGTTCTTCGGCCCTGGC ACCCGGCTGACAGTGCTGgaggacctgaataaggtgttcccccctgaggtggccgtgtttga gccaagcgaggccgagatctcccacacccagaaggccaccctggtgtgcctggcaaccggct tctttcccgatcacgtggagctgtcctggtgggtgaacggcaaggaggtgcactctggcgtg tgcacagacccacagcccctgaaggagcagcctgccctgaatgattcccgctattgtctgtc ctctcggctgagagtgtctgccaccttttggcagaacccacggaatcacttcagatgccagg tgcagttttacggcctgctgtgagaacgacgagtggaccaggatcgggccaagcctgtgaca cagatcgtgagcgcggaagcatggggcagagccgactgtggcttcaccagcgtgtcctatca gcagggcgtgctgtccgccaccatcctgtacgagatcctgctgggcaaggccacactgtatg ccgtgctggtgtctgccctggtgctgatggccatggtgaagagaaaagacttcggctccgga gcaaccaatttcagcctgctgaagcaggccggcgatgtggaggagaatcctggcccaATGGT GCTGAAGTTTTCTGTGAGCATCCTGTGGATTCAGCTGGCCTGGGTGTCCACCCAGCTCCTGG AGCAGAGCCCCCAGTTCCTGTCCATCCAGGAGGGCGAGAACCTGACCGTGTACTGCAACAGC TCTTCTGTCTTTTCATCACTGCAGTGGTATAGACAAGAACCGGGTGAAGGTCCAGTTCTGCT GGTGACCGTCGTCACCGGCGGCGAGGTGAAGAAGCTAAAGCGCCTGACGTTCCAGTTCGGAG ACGCGCGGAAGGACTCGTCGCTGCACATCACCGCCGCCCAGCCCGGCGACACCGGCCTGTAC CTGTGCGCTGGCGCGCGCAACTTCAACAAGTTCTACTTCGGCAGCGGCACCAAGCTGAACGT GAAACCGAATATCCAGAATCCGGACCcgcggtatatcaactgcgcgactcaaaatcatccg ataagagtgtctgtttgtttactgacttcgacagtcaaactaatgtctctcagagcaaagat tccgatgtctacatcactgacaagtgcgttctggatatgcggagcatggatttaagtccaa ctccgccgtagcctggtccaacaagtcagactttgcctgtgcaaatgctttcaacaactcaa ttatccctgaggacacttcttcctttcaccggagtcctcatgcgatgttaaactggtcgaa aaatcttttgagacggatacgaacctcaacttccaaaatttgagcgttattggctttaggat tctgcttctcaaggttgcggggttcaatctcctgatgacgttgcggctttggagcagctaa | TCR 57 Codon-optimized full sequence with human constant (nt) |
| 391 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCAGCACCCCCGAAGCTCCTACGAGCAGTACTTCGGG CCGGGCACCAGGCTGCACGGTCACAgaggacctgaataaggtgttcccccctgaggtggccgt gtttgagccaagcgaggccgagatctcccacacccagaaggccaccctggtgtgcctggcaa ccggcttctttcccgatcacgtggagctgtcctggtgggtgaacggcaaggaggtgcactct ggcgtgtgcacagacccacagcccctgaaggagcagcctgccctgaatgattcccgctattg tctgtcctctcggctgagagtgtctgccaccttttggcagaacccacggaatcacttcagat gccaggtgcagttttacggcctgctgtgagaacgacgagtggacccaggatcgggccaagcct gtgacacagatcgtgagcgcggaagcatggggcagagccgactgtggcttcaccagcgtgtc ctatcagcagggcgtgctgtccgccaccatcctgtacgagatcctgctgggcaaggccacac tgtatgccgtgctggtgtctgccctggtgctgatggccatggtgaagagaaaagacttcggc tccggagcaaccaatttcagcctgctgaagcaggccggcgatgtggaggagaatcctggccc aATGATGATATCCTTGAGAGTTTTACTGGTGATCCTGTGGCTTCAGTTAAGCTGGGTTTGGA GCCAACGAAGGAGGTGGAGCAGGATCCTGGACCCTTCAATGTTCCAGAGGGAGCCACTGTC GCTTTCAACTGTACTTACAGCAACAGTGCTTCTCAGTCTTTCTTCTGGTACAGACAGGATTG CAGGAAAGAACCTAAGTTGCTGATGTCGTATACTCCAGTGTAATGAAGATGGAAGGTTTA CAGCACAGCTCAATAGAGCCAGCCAGTATATTTCCCTGCTCATCAGAGACTCCAAGCTCAGT GATTCAGCCACCTACCTCTGTGTGGTGAACAGGGATAACTATGGTCAGAATTTTGTCTTTGG TCCCGGAACCAGATTGTCCGTGCTGCCCAATATCCAGAATCCGGACCcgcggtatatcaac tgcgcgactcaaaatcatccgataagagtgtctgtttgtttactgacttcgacagtcaaact aatgtctctcagagcaaagattccgatgtctacatcactgacaagtgcgttctggatatgcg gagcatggatttaagtccaactccgccgtagcctggtccaacaagtcagactttgcctgtg caaatgctttcaacaactcaattatccctgaggacacttcttcctttcaccggagtcctca tgcgatgttaaactggtcgaaaaatcttttgagacggatacgaacctcaacttccaaaattt gagcgttattggctttaggattctgcttctcaaggttgcggggttcaatctcctgatgacgt tgcggctttggagcagctaa | TCR 58 Native full sequence with human constant (nt) |

SEQUENCE TABLE

| SEQ ID NO | SEQUENCE | Description |
|---|---|---|
| 392 | ATGGATACCTGGCTCGTATGCTGGGCAATTTTTAGTCTCTTGAAAGCAGGACTCACAGAACC<br>TGAAGTCACCCAGACTCCCAGCCATCAGGTCACACAGATGGGACAGGAAGTGATCTTGCGT<br>GTGTCCCCATCTCTAATCACTTATACTTCTATTGGTACAGACAAATCTTGGGCAGAAAGTC<br>GAGTTTCTGGTTTCCTTTTATAATAATGAAATCTCAGAGAAGTCTGAAATATTCGATGATCA<br>ATTCTCAGTTGAAAGGCCTGATGGATCAAATTTCACTCTGAAGATCCGGTCCACAAAGCTGG<br>AGGACTCAGCCATGTACTTCTGTGCCTATTCGGGCAGGGCCTCCTACGAGCAGTACTTCGGG<br>CCGGGCACCAGGCTCACGGTCACAgaggacctgaataaggtgttcccccctgaggtggccgt<br>gtttgagccaagcgaggccgagatctcccacacccagaaggccaccctggtgtgcctggcaa<br>ccggcttctttcccgatcacgtggagctgtcctggtgggtgaacggcaaggaggtgcactct<br>ggcgtgtgcacagacccacagccccgaaggagcagcctgccctgaatgattcccgctattg<br>tctgtcctctcggctgagagtgtctgccaccttttggcagaacccacggaatcacttcagat<br>gccaggtgcagttttacggcctgtctgagaacgacgagtggacccaggatcgggccaagcct<br>gtgacacagatcgtgagcgcggaagcatggggcagagccgactgtggcttcaccagcgtgtc<br>ctatcagcagggcgtgctgtccgccaccatcctgtacgagatcctgctgggcaaggccacac<br>tgtatgccgtgctggtgtctgccctggtgctgatggccatggtgaagagaaaagacttcggc<br>tccggagcaaccaatttcagcctgctgaagcaggccggcgatgtggaggagaatcctggccc<br>aATGAAGAGGGAGAGGGAGATGCTACTCATCACATCAATGTTGGTCTTATGGATGCAATTGT<br>CACAGGTGAATGGACAACAGGTAATGCAAATTCCTCAGTACCAGCATGTACAAGAAGGAGAG<br>GACTTCACCACGTACTGCAATTCCTCAACTACTTTAAGCAATATACAGTGGTATAAGCAAAG<br>GCCTGGTGGACATCCCGTTTTTTGATACAGTTAGTGAAGAGTGGAAGTGGAAGAAGCAGA<br>AAAGACTGACATTTCAGTTTGGAGAAGCAAAAAAGAACAGCTCCCTGCACATCACAGCCACC<br>CAGACTACAGATGTAGGAACCTACTTCTGTGCACCCAAGCGGGAATATGGAAACAAACTGGT<br>CTTTTGGCGCAGGAACCATTCTGAGAGTCAAGTCCAATATCCAGAATCCGGACCccgcggtat<br>atcaactgcgcgactcaaaatcatccgataagagtgtctgtttgtttactgacttcgacagt<br>caaactaatgtctctcagagcaaagattccgatgtctacatcactgacaagtgcgttctgga<br>tatgcggagcatggattttaagtccaactccgccgtagcctggtccaacaagtcagactttg<br>cctgtgcaaatgctttcaacaactcaattatccctgaggacactttctttccttcaccggag<br>tcctcatgcgatgttaaactggtcgaaaaatcttttgagacggatacgaacctcaacttcca<br>aaatttgagcgttattggctttaggattctgcttctcaaggttgcggggttcaatctcctga<br>tgacgttgcggctttggagcagctaa | TCR 59 Native full sequence with human constant (nt) |
| 393 | ATGGATACCTGGCTCGTATGCTGGGCAATTTTTAGTCTCTTGAAAGCAGGACTCACAGAACC<br>TGAAGTCACCCAGACTCCCAGCCATCAGGTCACACAGATGGGACAGGAAGTGATCTTGCGT<br>GTGTCCCCATCTCTAATCACTTATACTTCTATTGGTACAGACAAATCTTGGGCAGAAAGTC<br>GAGTTTCTGGTTTCCTTTTATAATAATGAAATCTCAGAGAAGTCTGAAATATTCGATGATCA<br>ATTCTCAGTTGAAAGGCCTGATGGATCAAATTTCACTCTGAAGATCCGGTCCACAAAGCTGG<br>AGGACTCAGCCATGTACTTCTGTGCCATCAGTCGGACAGTCTCCTACGAGCAGTACTTCGGG<br>CCGGGCACCAGGCTCACGGTCACAgaggacctgaataaggtgttcccccctgaggtggccgt<br>gtttgagccaagcgaggccgagatctcccacacccagaaggccaccctggtgtgcctggcaa<br>ccggcttctttcccgatcacgtggagctgtcctggtgggtgaacggcaaggaggtgcactct<br>ggcgtgtgcacagacccacagccccgaaggagcagcctgccctgaatgattcccgctattg<br>tctgtcctctcggctgagagtgtctgccaccttttggcagaacccacggaatcacttcagat<br>gccaggtgcagttttacggcctgtctgagaacgacgagtggacccaggatcgggccaagcct<br>gtgacacagatcgtgagcgcggaagcatggggcagagccgactgtggcttcaccagcgtgtc<br>ctatcagcagggcgtgctgtccgccaccatcctgtacgagatcctgctgggcaaggccacac<br>tgtatgccgtgctggtgtctgccctggtgctgatggccatggtgaagagaaaagacttcggc<br>tccggagcaaccaatttcagcctgctgaagcaggccggcgatgtggaggagaatcctggccc<br>aATGATGAAATCCTTGAGAGTTTTACTAGTGATCCTGTGGCTTCAGTTGAGCTGGGTTTGGA<br>GCCAACAGAAGGAGGTGGAGCAGAATTCTGGACCCCTCAGTGTTCCAGAGGGAGCCATTGCC<br>TCTCTCAACTGCACTTACAGTGACCGAGGTTCCCAGTCCTTCTTCTGGTACAGACAATATTC<br>TGGGAAAAGCCCTGAGTTGATAATGTTCATATACTCCAATGGTGACAAAGAAGATGGAAGGT<br>TTACAGCACAGCTCAATAAAGCCAGCCAGTATGTTTCTCTGCTCATCAGAGACTCCCAGCCC<br>AGTGATTCAGCCACCTACCTCTGTGCCGTGAACATGTTGGGGAGTGGAGGTAGCAACTATAA<br>ACTGACATTTGGAAAAGGAACTCTCTTAACCGTGAATCCAAATATCCAGAATCCGGACCccg<br>cggtatatcaactgcgcgactcaaaatcatccgataagagtgtctgtttgtttactgacttc<br>gacagtcaaactaatgtctctcagagcaaagattccgatgtctacatcactgacaagtgcgt<br>tctggatatgcggagcatggattttaagtccaactccgccgtagcctggtccaacaagtcag<br>actttgcctgtgcaaatgctttcaacaactcaattatccctgaggacactttctttccttca<br>ccggagtcctcatgcgatgttaaactggtcgaaaaatcttttgagacggatacgaacctcaa<br>cttccaaaatttgagcgttattggctttaggattctgcttctcaaggttgcggggttcaatc<br>tcctgatgacgttgcggctttggagcagctaa | TCR 60 Native full sequence with human constant (nt) |
| 394 | ATGGATACCTGGCTCGTATGCTGGGCAATTTTTAGTCTCTTGAAAGCAGGACTCACAGAACC<br>TGAAGTCACCCAGACTCCCAGCCATCAGGTCACACAGATGGGACAGGAAGTGATCTTGCGT<br>GTGTCCCCATCTCTAATCACTTATACTTCTATTGGTACAGACAAATCTTGGGCAGAAAGTC<br>GAGTTTCTGGTTTCCTTTTATAATAATGAAATCTCAGAGAAGTCTGAAATATTCGATGATCA<br>ATTCTCAGTTGAAAGGCCTGATGGATCAAATTTCACTCTGAAGATCCGGTCCACAAAGCTGG<br>AGGACTCAGCCATGTACTTCTGTGCCAGCACCAAACGTTTTAGCTACGAGCAGTACTTCGGG<br>CCGGGCACCAGGCTCACGGTCACAgaggacctgaataaggtgttcccccctgaggtggccgt<br>gtttgagccaagcgaggccgagatctcccacacccagaaggccaccctggtgtgcctggcaa<br>ccggcttctttcccgatcacgtggagctgtcctggtgggtgaacggcaaggaggtgcactct<br>ggcgtgtgcacagacccacagccccgaaggagcagcctgccctgaatgattcccgctattg<br>tctgtcctctcggctgagagtgtctgccaccttttggcagaacccacggaatcacttcagat | TCR 61 Native full sequence with human constant (nt) |

| SEQ ID NO | SEQUENCE | Description |
|---|---|---|
| | gccaggtgcagttttacggcctgtctgagaacgacgagtggacccaggatcgggccaagcct gtgacacagatcgtgagcgcggaagcatggggcagagccgactgtggcttcaccagcgtgtc ctatcagcagggcgtgctgtccgccaccatcctgtacgagatcctgctgggcaaggccacac tgtatgccgtgctggtgtctgccctggtgctgatggccatggtgaagagaaaagacttcggc tccggagcaaccaatttcagcctgctgaagcaggccggcgatgtggaggagaatcctggccc aATGATGAAATCCTTGAGAGTTTTACTAGTGATCCTGTGGCTTCAGTTGAGCTGGGTTTGGA GCCAACAGAAGGAGGTGGAGCAGAATTCTGGACCCCTCAGTGTTCCAGAGGGAGCCATTGCC TCTCTCAACTGCACTTACAGTGACCGAGGTTCCCAGTCCTTCTTCTGGTACAGACAATATTC TGGGAAAAGCCCTGAGTTGATAATGTTCATATACTCCAATGGTGACAAAGAAGATGGAAGGT TTACAGCACAGCTCAATAAAGCCAGCCAGTATGTTTCTCTGCTCATCAGAGACTCCCAGCCC AGTGATTCAGCCACCTACCTCTGTGCCGTGAACATAGAGAATAACAATGCCAGACTCATGTT TGGAGATGGAACTCAGCTGGTGGTGAAGCCCAATATCCAGAATCCGGACCcgcgcgtatatc aactgcgcgactcaaaatcatccgataagagtgtctgtttgtttactgacttcgacagtcaa actaatgtctctcagagcaaagattccgatgtctacatcactgacaagtgcgttctggatat gcggagcatggattttaagtccaactccgccgtagcctggtccaacaagtcagactttgcct gtgcaaatgctttcaacaactcaattatccctgaggacactttctttccttcaccggagtcc tcatgcgatgttaaactggtcgaaaaatctttttgagacggatacgaacctcaacttccaaaa tttgagcgttattggctttaggattctgcttctcaaggttgcggggttcaatctcctgatga cgttgcggctttggagcagctaa | |
| 395 | ATGGGCACCAGGCTCCTCTGCTGGGCGGCCCTCTGTCTCCTGGGAGCAGAACTCACAGAAGC TGGAGTTGCCCAGTCTCCCAGATATAAGATTATAGAGAAAAGGCAGAGTGTGGCTTTTTGGT GCAATCCTATATCTGGCCATGCTACCCTTTACTGGTACCAGCAGATCCTGGGACAGGGCCCA AAGCTTCTGATTCAGTTTCAGAATAACGGTGTAGTGGATGATTTCACAGTTGCCTAAGGATCG ATTTTCTGCAGAGAGGCTCAAAGGAGTAGACTCCACTCTCAAGATCCAgCCTGCAAAGCTTG AGGACTCGGCCGTGTATCTCTGTGCCAGCAGCTTAGATACCCGGGGCTCCTCCTACAATGAG CAGTTCTTCGGGCCAGGGACACGGCTCACCGTGCTAgaggacctgaataaggtgttccccccc tgaggtggccgtgtttgagccaagcgaggccgagatctcccacacccagaaggccaccctgg tgtgcctggcaaccggcttctttcccgatcacgtggagctgtcctggtgggtgaacggcaag gaggtgcactctggcgtgtgcacagacccacagcccctgaaggagcagcctgccctgaatga ttcccgctattgtctgtcctctcggctgagagtgtctgccacctttttggcagaacccacgga atcacttcagatgccaggtgcagttttacggcctgtctgagaacgacgagtggacccaggat cgggccaagcctgtgacacagatcgtgagcgcggaagcatggggcagagccgactgtggctt caccagcgtgtcctatcagcagggcgtgctgtccgccaccatcctgtacgagatcctgctgg gcaaggccacactgtatgccgtgctggtgtctgccctggtgctgatggccatggtgaagaga aaagacttcggctccggagcaaccaatttcagcctgctgaagcaggccggcgatgtggagga gaatcctggcccaATGGAGTTAGCTTGCTGTGGGCAGTCGTGGTCTCCACCTGTCTTG AATCCGGCATGGCCCAGACAGTCACTCAGTCTCAACCAGAGATGTCTGTGCAGGAGGCAGAG ACTGTGACCCTGAGTTGCACATATGACACCAGTGAGAATAATTATTATTTGTTCTGGTACAA GCAGCCTCCCAGCAGGCAGATGATTCTCGTTATTCGCCAAGAAGCTTATAAGCAACAGAATG CAACGGAGAATCGTTTCTCTGTGAACTTCCAGAAAGCAGCCAAATCCTTCAGTCTCAAGATC TCAGACTCACAGCTGGGGGACACTGCGATGTATTTCTGTGCTCTCTATACCTACAAATACAT CTTTTGGAACAGGCACCAGGCTGAAGGTTTTAGCAAATATCCAGAATCCGGACCcgcggtat atcaactgcgcgactcaaaatcatccgataagagtgtctgtttgtttactgacttcgacagt caaactaatgtctctcagagcaaagattccgatgtctacatcactgacaagtgcgttctgga tatgcggagcatggattttaagtccaactccgccgtagcctggtccaacaagtcagactttg cctgtgcaaatgctttcaacaactcaattatccctgaggacactttctttccttcaccggag tcctcatgcgatgttaaactggtcgaaaaatctttttgagacggatacgaacctcaacttcca aaatttgagcgttattggctttaggattctgcttctcaaggttgcggggttcaatctcctga tgacgttgcggctttggagcagctaa | TCR 62 Native full sequence with human constant (nt) |
| 396 | ATGGGCACCAGGCTCCTCTGCTGGGTGGTCCTGGGTTTCCTAGGGACAGATCACACAGGTGC TGGAGTCTCCCAGTCCCCTAGGTACAAAGTCGCAAAGAGAGGACAGGATGTAGCTCTCAGGT GTGATCCAATTTCGGGTCATGTATCCCTTTTTTGGTACCAACAGGCCCTGGGGCAGGGGCCA GAGTTTCTGACTTATTTCCAGAATGAAGCTCAACTAGACAAATCGGGGCTGCCCAGTGATCG CTTCTTTGCAGAAAGGCCTGAGGGATCCGTCTCCACTCTGAAGATCCAGCGCACACAGCAGG AGGACTCCGCCGTGTATCTCTGTGCCAGCAGACCAAGACAGGGGTATAATGACAATGAGCAG TTCTTCGGGCCAGGGACACGGCTCACCGTGCTAgaggacctgaataaggtgttccccccctga ggtggccgtgtttgagccaagcgaggccgagatctcccacacccagaaggccaccctggtgt gcctggcaaccggcttctttcccgatcacgtggagctgtcctggtgggtgaacggcaaggag gtgcactctggcgtgtgcacagacccacagcccctgaaggagcagcctgccctgaatgattc ccgctattgtctgtcctctcggctgagagtgtctgccacctttttggcagaacccacggaatc acttcagatgccaggtgcagttttacggcctgtctgagaacgacgagtggacccaggatcgg gccaagcctgtgacacagatcgtgagcgcggaagcatggggcagagccgactgtggcttcac cagcgtgtcctatcagcagggcgtgctgtccgccaccatcctgtacgagatcctgctgggca aggccacactgtatgccgtgctggtgtctgccctggtgctgatggccatggtgaagagaaaa gacttcggctccggagcaaccaatttcagcctgctgaagcaggccggcgatgtggaggagaa tcctggcccaATGGAGACTGTTCTGCACGTACTCTGTAGGGATATTGGGGTTCCAAGCAGCCT GGGTCAGTAGCCAAGAACTGGAGCAGAGTCCTCAGTCCTTGATCGTCCAAGAGGGAAAGAAT CTCACCATAAACTGCACGTCATCAAAGACGTTATATGCTTATACTGGTATAAGCAAAAGTA TGGTGAAGGTCTTATCTTCTTGATGATGCTACAGAAAGGTGGGGAAGAGAAAAGTCATGAAA AGATAACTGCCAAGTTGGATGAGAAAAAGCAGCAAAGTTCCCTGCATATCACAGCCTCCCAG CCCAGCCATGCAGGCATCTACCTCTGTGGAGCAGACATAGACGACTACAAGCTCAGCTTTGG | TCR 63 Native full sequence with human constant (nt) |

SEQUENCE TABLE

| SEQ ID NO | SEQUENCE | Description |
|---|---|---|
|  | AGCCGGAACCACAGTAACTGTAAGAGCAAATATCCAGAATCCGGACCCcgcggtatatcaac tgcgcgactcaaaatcatccgataagagtgtctgtttgtttactgacttcgacagtcaaact aatgtctctcagagcaaagattccgatgtctacatcactgacaagtgcgttctggatatgcg gagcatggattttaagtccaactccgccgtagcctggtccaacaagtcagactttgcctgtg caaatgctttcaacaactcaattatccctgaggacactttctttccttcaccggagtcctca tgcgatgttaaactggtcgaaaaatcttttgagacggatacgaacctcaacttccaaaattt gagcgttattggctttaggattctgcttctcaaggttgcggggttcaatctcctgatgacgt tgcggctttggagcagctaa |  |
| 397 | ATGGGCTGCAGGCTCCTCTGCTGTGTGGTCTTCTGCCTCCTCCAAGCAGGTCCCTTGGACAC AGCTGTTTCCCAGACTCCAAAATACCTGGTCACACAGATGGGAAACGACAAGTCCATTAAAT GTGAACAAAATCTGGGCCATGATACTATGTTATTGGTATAAACAGGACTCTAAGAAATTTCTG AAGATAATGTTTAGCTACAATAATAAGGAGCTCATTATAAATGAAACAGTTCCAAATCGCTT CTCACCTAAATCTCCAGACAAAGCTCACTTAAATCTTCACATCAATTCCCTGGAGCTTGGTG ACTCTGCTGTGTATTTCTGTGCCAGCAGCCAGGGGAAGCTGGGGCCAACGTCCTGACTTTC GGGGCCGGCAGCAGGCTGACCGTGCTGgaggacctgaataaggtgttccccctgaggtggc cgtgtttgagccaagcgaggccgagatctcccacacccagaaggccaccctggtgtgcctgg caaccggcttctttcccgatcacgtggagctgtcctggtgggtgaacggcaaggaggtgcac tctggcgtgtgcacagacccacagcccctgaaggagcagcctgccctgaatgattcccgcta ttgtctgtcctctcggctgagagtgtctgccacctttggcagaacccacggaatcacttca gatgccaggtgcagttttacggcctgtctgagaacgacgagtggacccaggatcgggccaag cctgtgacacagatcgtgagcgcggaagcatggggcagagccgactgtggcttcaccagcgt gtcctatcagcagggcgtgctgtccgccaccatcctgtacgagatcctgctgggcaaggcca cactgtatgccgtgctggtgtctgccctggtgctgatggccatggtgaagagaaaagacttc ggctccggagcaaccaatttcagctgctgaagcaggccggcgatgtggaggagaatcctgg cccaATGAACATGCTGACTGCCAGCCTGTTGAGGGCAGTCATAGCCTCCATCTGTGTTGTAT CCAGCATGGCTCAGAAGGTAACTCAAGCGCAGACTGAAATTTCTGTGGTGGAGAAGGAGGAT GTGACCTTGGACTGTGTGTATGAAACCCGTGATCACTTATTACTTATTCTGGTACAAGCA ACCACCAAGTGGAGAATTGGTTTTCCTTATTCGTCGGAACTCTTTTGATGAGCAAAATGAAA TAAGTGGTCGGTATTCTTGGAACTTCCAGAAATCCACCAGTTCCTTCAACTTCACCATCACA GCCTCACAAGTCGTGGACTCAGCAGTATACTTCTGTGCTCTGAGTGGGGTCGATAACTATGG TCAGAATTTTGTCTTTGGTCCCGGAACCAGATTGTCCGTGCTGCCCAATATCCAGAATCCGG ACCCcgcggtatatcaactgcgcgactcaaaatcatccgataagagtgtctgtttgtttact gacttcgacagtcaaactaatgtctctcagagcaaagattccgatgtctacatcactgacaa gtgcgttctggatatgcggagcatggattttaagtccaactccgccgtagcctggtccaaca agtcagactttgcctgtgcaaatgctttcaacaactcaattatccctgaggacactttcttt ccttcaccggagtcctcatgcgatgttaaactggtcgaaaaatcttttgagacggatacgaa cctcaacttccaaaatttgagcgttattggctttaggattctgcttctcaaggttgcgggt tcaatctcctgatgacgttgcggctttggagcagctaa | TCR 64 Native full sequence with human constant (nt) |
| 398 | ATGGGAATCAGGCTCCTCTGTCGTGTGGCCTTTTGTTTCCTGGCTGTAGGCCTCGTAGATGT GAAAGTAACCCAGAGCTCGAGATATCTAGTCAAAAGGACGGGAGAGAAAGTTTTTCTGGAAT GTGTCCAGGATATGGACCATGAAAATATGTTCTGGTATCGACAAGACCCAGGTCTGGGGCTA CGGCTGATCTATTTCTCATATGATGTTAAAATGAAAGAAAAAGGAGATATTCCTGAGGGGTA CAGTGTCTCTAGAGAGAAGAAGGAGCGCTTCTCCCTGATTCTGGAGTCCGCCAGCACCAACC AGACATCTATGTACCTCTGTGCCAGCAGTTTATGGGGACGGCGAAACACCGGGGAGCTGTTT TTTGGAGAAGGCTCTAGGCTGACCGTACTGgaggacctgaataaggtgttccccctgaggt ggccgtgtttgagccaagcgaggccgagatctcccacacccagaaggccaccctggtgtgcc tggcaaccggcttctttcccgatcacgtggagctgtcctggtgggtgaacggcaaggaggtg cactctggcgtgtgcacagacccacagcccctgaaggagcagcctgccctgaatgattcccg ctattgtctgtcctctcggctgagagtgtctgccacctttggcagaacccacggaatcact tcagatgccaggtgcagttttacggcctgtctgagaacgacgagtggacccaggatcgggcc aagcctgtgacacagatcgtgagcgcggaagcatggggcagagccgactgtggcttcaccag cgtgtcctatcagcagggcgtgctgtccgccaccatcctgtacgagatcctgctgggcaagg ccacactgtatgccgtgctggtgtctgccctggtgctgatggccatggtgaagagaaaagac ttcggctccggagcaaccaatttcagctgctgaagcaggccggcgatgtggaggagaatcc tggcccaATGGAGAAAATGTTGGAGTGTGCATTCATAGTCTTGTGGCTTCAGCTTGGCTGGT TGAGTGGAGAAGACCAGGTGACGCAGAGTCCCGAGGCCCTGAGACTCCAGGAGGGAGAGAGT AGCAGTGCTtAACTGCAGTTACACAGTCAGCGGTTTAAGAGGGCTGTTCTGGTATAGGCAGA TCCTGGGAAAGGCCCTGAATTCCTCTTCACCCTGTATTCAGCTGGGGAAGAAAAGGAGAAAG AAAGGCTAAAAGCCACATTAACAAAGAAGGAAAGCTTTCTGCACATCACAGCCCCTAAACCT GAAGACTCAGCCACTTATCTCTGTGCTGTGCAGGCAGAAAGAGGCTCAACCCTGGGGAGGCT ATACTTTGGAAGAGGAACTCAGTTGACTGTCTGGCCTAATATCCAGAATCCGGACCCcgcgg tatatcaactgcgcgactcaaaatcatccgataagagtgtctgtttgtttactgacttcgac agtcaaactaatgtctctcagagcaaagattccgatgtctacatcactgacaagtgcgttct ggatatgcggagcatggattttaagtccaactccgccgtagcctggtccaacaagtcagact ttgcctgtgcaaatgctttcaacaactcaattatccctgaggacactttctttccttcaccg gagtcctcatgcgatgttaaactggtcgaaaaatcttttgagacggatacgaacctcaactt ccaaaatttgagcgttattggctttaggattctgcttctcaaggttgcggggttcaatctcc tgatgacgttgcggctttggagcagctaa | TCR 65 Native full sequence with human constant (nt) |

SEQUENCE TABLE

| SEQ ID NO | SEQUENCE | Description |
|---|---|---|
| 399 | atgggacccatggccaatagcgccatggataccagagtgctgtgctgcgccgtgatctgtct gcttggagccggactgtctaatgccggcgtgatgcagaacccagacacctcgttcggagaa gaggccaagaggccagactgagatgcagccctatgaagggccacagccacgtgtactggtac agacagctgcctgaagagggcctgaagttcatggtgtacctgcagaaagagaacatcatcga cgagagcggcatgcccaaagagcggttctctgccgagtttcccaaagagggccccagcatcc tgagaatccagcaggttgtgcgggagatagcgccgcctacttttgtgccagctctcccgat gagagccgggactctaatcagcctcagcactttggcgacggcaccaggctgtctattctcga ggacctgaataaggtgttccccctgaggtggccgtgtttgagccaagcgaggccgagatct cccacacccagaaggccaccctggtgtgcctggcaaccggcttctttcccgatcacgtggag ctgtcctggtgggtaacggcaaggaggtgcactctggcgtgtgcacagacccacagcccct gaaggagcagcctgccctgaatgattcccgctattgtctgtcctctcggctgagagtgtctg ccacctttggcagaacccacggaatcacttcagatgccaggtgcagttttacggcctgtct gagaacgacgagtggacccaggatcgggccaagcctgtgacacagatcgtgagcgcggaagc atggggcagagccgactgtggcttcaccagcgtgtcctatcagcagggcgtgctgtccgcca ccatcctgtacgagatcctgctgggcaaggccacactgtatgccgtgctggtgtctgcctg gtgctgatggccatggtgaagagaaaagacttctaaggctccggagcaaccaatttcagcct gctgaagcaggccggcgatgtggaggagaatcctggcccaATGGCTCAAGAGCTGGGCATGC AGTGTCAGGCCAGAGGAATCCTGCAGCAGATGTGGGGAGTGTTCCTGCTGTACGTGTCCATG AAGATGGGCGGCACCACCGGCCAGAACATCGATCAGCCTACAGAGATGACCGCCACCGAGGG CGCCATCGTGCAGATCAATTGCACCTACCAGACCAGCGGCTTCAACGGCCTGTTCTGGTATC AGCAGCATGCCGGCGAGGCCCCTACCTTCCTGAGCTACAATGTGCTGGACGGCCTGGAAGAG AAGGGCAGATTCAGCAGCTTCCTGTCCAGAAGCAAGGGCTACAGCTACCTGCTGCTGAAAGA ACTGCAGATGAAGGACAGCGCCTCCTACCTGTGCGCCGTTAGAGATTGGGGATACGGCGGAG CCACCAACAAGCTGATCTTTGGCACAGGCACACTGCTGGCCGTGCAGCCTAATATCCAGAAT CCGGACCcgcggtatatcaactgcgcgactcaaaatcatccgataagagtgtctgtttgtt tactgacttcgacagtcaaactaatgtctctcagagcaaagattccgatgtctacatcactg acaagtgcgttctggatatgcggagcatggattttaagtccaactccgccgtagcctggtcc aacaagtcagactttgcctgtgcaaatgctttcaacaactcaattatccctgaggacacttt cttcctcaccggagtcctcatgcgatgtttaaactggtcgaaaaatcttttgagacggata cgaacctcaacttccaaaatttgagcgttattggctttaggattctgcttctcaaggttgcg gggttcaatctcctgatgacgttgcggctttggagcagctaa | TCR 56 Codon-optimized full sequence with human constant (nt) |
| 400 | ATGGCCAACTCTGCTATGGACACCAGAGTACTCTGCTGTGCGGTCATCTGTCTTCTGGGGGC AGGTCTCTCAAATGCCGGCGTCATGCAGAACCCAAGACACCTGGTCAGGAGGAGGGGACAGG AGGCAAGACTGAGATGCAGCCCAATGAAAGGACACAGTCATGTTTACTGGTATCGGCAGCTC CCAGAGGAAGGTCTGAAATTCATGGTTTATCTCCAGAAAGAAAATATCATAGATGAGTCAGG AATGCCAAAGGAACGATTTTCTGCTGAATTTCCCAAAGAGGGCCCCAGCATCCTGAGGATCC AGCAGGTAGTGCGAGGAGATTCGGCAGCTTATTTCTGTGCCAGCTCACCAGACGAAAGCAGG GATAGCAATCAGCCCCAGCATTTTGGTGATGGGACTCGACTCTCCATCCTAgaagatctgaa gaacgtcttcccacctgaggtggccgtgttcgagccttctgaggccgagatcagccacacac agaaagccacactcgtgtgtctggccaccggcttctatcccgatcacgtggaactgtcttgg tgggtcaacggcaaagaggtgcacagcggcgtctgtaccgatcctcagcctctgaaagagca gccccgctctgaacgacagcagatactgcctgagcagcagactgagagtgtccgccaccttct ggcagaaccccagaaaccacttcagatgccaggtgcagttctacggcctgagcgagaacgat gagtggacccaggatagagccaagcctgtgacacagatcgtgtctgccgaagcctggggcag agccgattgtggctttaccagcgagagctaccagcagggcgtgctgtctgccacaatcctgt acgagatcctgctgggcaaagcactctgtacgccgtgctggtgtctgccctggtgctgatg gccatggtcaagcggaaggatagcagaggcggaagcggcgccacaaacttctctcactgctgaa acaggctggcgacgtggaggagaatcctggcccaATGGCTCAGGAACTGGGAATGCAGTGCC AGGCTCGTGGTATCCTGCAGCAGATGTGGGGAGTTTTCCTTCTTTATGTTTCCATGAAGATG GGAGGCACTACAGGACAAAACATTGACCAGCCCACTGAGATGACAGCTACGGAAGGTGCCAT TGTCCAGATCAACTGCACGTACCAGACATCTGGGTTCAACGGGCTGTTCTGGTACCAGCAAC ATGCTGGCGAAGCACCCACATTTCTGTCTTACAATGTTCTGGATGGTTTGGAGGAGAAAGGT CGTTTTTCTTCATTCCTTAGTCGGTCTAAAGGGTACAGTTACCTCCTTTTGAAGGAGCTCCA GATGAAAGACTCTGCCTCTTACCTCTGTGCTGTGAGAGATTGGGGATATGGTGGTGCTACAA ACAAGCTCATCTTTGGAACTGGCACTCTGCTTGCTGTCCAGCCAAATATCCAGAATCGGAC Ccgcggtatatcaactgcgcgactcaaaatcatccgataagagtgtctgtttgtttactga cttcgacagtcaaactaatgtctctcagagcaaagattccgatgtctacatcactgacaagt gcgttctggatatgcggagcatggattttaagtccaactccgccgtagcctggtccaacaag tcagactttgcctgtgcaaatgctttcaacaactcaattatccctgaggacactttctttcc ttcaccggagtcctcatgcgatgtttaaactggtcgaaaaatcttttgagacggatacgaacc tcaacttccaaaatttgagcgttattggctttaggattctgcttctcaaggttgcggggttc aatctcctgatgacgttgcggctttggagcagctaa | TCR 56 Native full sequence with human constant (nt) |
| 401 | atgggacccatggccaatagcgccatggataccagagtgctgtgctgcgccgtgatctgtct gcttggagccggactgtctaatgccggcgtgatgcagaacccagacacctcgttcggagaa gaggccaagaggccagactgagatgcagccctatgaagggccacagccacgtgtactggtac agacagctgcctgaagagggcctgaagttcatggtgtacctgcagaaagagaacatcatcga cgagagcggcatgcccaaagagcggttctctgccgagtttcccaaagagggccccagcatcc tgagaatccagcaggttgtgcgggagatagcgccgcctacttttgtgccagctctcccgat gagagccgggactctaatcagcctcagcactttggcgacggcaccaggctgtctattctcga agatctgaagaacgtcttcccacctgaggtggccgtgttcgagccttctgaggccgagatca | TCR 56 Codon-optimized full sequence with human constant (nt) |

| SEQ ID NO | SEQUENCE | Description |
|---|---|---|
| | gccacacacagaaagccacactcgtgtgtctggccaccggcttctatcccgatcacgtggaa<br>ctgtcttggtgggtcaacggcaaagaggtgcacagcggcgtctgtaccgatcctcagcctct<br>gaaagagcagcccgctctgaacgacagcagatactgcctgagcagcagactgagagtgtccg<br>ccaccttctggcagaaccccagaaaccacttcagatgccaggtgcagttctacggcctgagc<br>gagaacgatgagtggacccaggatagagccaagcctgtgacacagatcgtgtctgccgaagc<br>ctggggcagagccgattgtggctttaccagcgagagctaccagcagggcgtgctgtctgcca<br>caatcctgtacgagatcctgctgggcaaagccactctgtacgccgtgctggtgtctgccctg<br>gtgctgatggccatggtcaagcggaaggatagcagaggcgaagcggcgcacaaacttctc<br>actgctgaaacaggctggcgacgtggaggagaatcctggcccaATGGCTCAAGAGCTGGGCA<br>TGCAGTGTCAGGCCAGAGGAATCCTGCAGCAGATGTGGGGAGTGTTCCTGCTGTACGTGTCC<br>ATGAAGATGGGCGGCACCACCGGCCAGAACATCGATCAGCCTACAGAGATGACCGCCACCGA<br>GGGCGCCATCGTGCAGATCAATTGCACCTACCAGACCAGCGGCTTCAACGGCCTGTTCTGGT<br>ATCAGCAGCATGCCGGCGAGGCCCCTACCTTCCTGAGCTACAATGTGCTGGACGGCCTGGAA<br>GAGAAGGGCAGATTCAGCAGCTTCCTGTCCAGAAGCAAGGGCTACAGCTACCTGCTGCTGAA<br>AGAACTGCAGATGAAGGACAGCGCCTCCTACCTGTGCGCCGTTAGAGATTGGGGATACGGCG<br>GAGCCACCAACAAGCTGATCTTTGGCACAGGCACACTGCTGGCCGTGCAGCATAATATCCAG<br>AATCCGGACCccgcggtatatcaactgcgcgactcaaaatcatccgataagagtgtctgttt<br>gtttactgacttcgacagtcaaactaatgtctctcagagcaaagattccgatgtctacatca<br>ctgacaagtgcgttctggatatgcggagcatggattttaagtccaactccgccgtagcctgg<br>tccaacaagtcagactttgcctgtgcaaatgctttcaacaactcaattatccctgaggacac<br>tttctttccttcaccggagtcctcatgcgatgttaaactggtcgaaaaatcttttgagacgg<br>atacgaacctcaacttccaaaatttgagcgttattggctttaggattctgcttctcaaggtt<br>gcggggttcaatctcctgatgacgttgcggctttggagcagctaa | |
| 402 | ATGCTCCTGCTGCTTCTGCTCCTCGGGCCCGGCAGCGGTCTCGGCGCCGTCGTGTCGCAGCA<br>CCCGTCGTGGGTGATTTGCAAGAGCGGAACGAGCGTGAAGATCGAGTGCCGCTCGCTCGACT<br>TCCAGGCCACAACCATGTTCTGGTACCGCCAGTTTCCCAAGCAGAGCCTCATGCTGATGGCC<br>ACAAGCAATGAAGGCAGCAAGGCCCACTTATGAACAGGGCGTGGAGAAGGACAAGTTTCTGAT<br>CAACCACGCCTCCCTGACCCTGTCCACCCTCACTGTGACCAGCGCCCACCCTGAGGACAGCA<br>GCTTCTACATCTGCAGCGCCCGCAGCTGGAGGGGCGGCCTGGAGCAGTTCTTCGGCCCTGGC<br>ACCCGGCTGACAGTGCTGgaagatctgaagaacgtcttcccacctgaggtggccgtgttcga<br>gccttctgaggccgagatcagccacacacagaaagccacactcgtgtgtctggccaccggct<br>tctatcccgatcacgtggaactgtcttggtgggtcaacggcaaagaggtgcacagcggcgtc<br>tgtaccgatcctcagcctctgaaagagcagcccgctctgaacgacagcagatactgcctgag<br>cagcagactgagagtgtccgccaccttctggcagaaccccagaaaccacttcagatgccagg<br>tgcagttctacggcctgagcgagaacgatgagtggacccaggatagagccaagcctgtgaca<br>cagatcgtgtctgccgaagcctggggcagagccgattgtggctttaccagcgagagctacca<br>gcagggcgtgctgtctgccacaatcctgtacgagatcctgctgggcaaagccactctgtacg<br>ccgtgctggtgtctgccctggtgctgatggccatggtcaagcggaaggatagcagaggcgga<br>agcggcgccacaaacttctcactgctgaaacaggctggcgacgtggaggagaatcctggccc<br>aATGGTGCTGAAGTTTTCTGTGAGCATCCTGTGGATTCAGCTGGCCTGGGTGTCCACCCAGC<br>TCCTGGAGCAGAGCCCCCAGTTCCTGTCCATCCAGGAGGGCGAGAACCTGACCGTGTACTGC<br>AACAGCTCTTCTGTCTTTTCATCACTGCAGTGGTATAGACAAGAACCGGGTGAAGGTCCAGT<br>TCTGCTGGTGACCGTCGTCACCGGCGGCGAGGTGAAGAAGCTAAAGCGCCTGACGTTCCAGT<br>TCGGAGACGCGCGGAAGGACTCGTCGCTGCACATCACCGCCGCCCAGCCCGGCGACACCGGC<br>CTGTACCTGTGCGCTGGCGCGCGCAACTTCAACAAGTTCTACTTCGGCAGCGGCACCAAGCT<br>GAACGTGAAACCGAATATCCAGAATCCGGACCccgcggtatatcaactgcgcgactcaaaat<br>catccgataagagtgtctgtttgtttactgacttcgacagtcaaactaatgtctctcagagc<br>aaagattccgatgtctacatcactgacaagtgcgttctggatatgcggagcatggattttaa<br>gtccaactccgccgtagcctggtccaacaagtcagactttgcctgtgcaaatgctttcaaca<br>actcaattatccctgaggacactttctttccttcaccggagtcctcatgcgatgttaaactg<br>gtcgaaaaatcttttgagacggatacgaacctcaacttccaaaatttgagcgttattggctt<br>taggattctgcttctcaaggttgcggggttcaatctcctgatgacgttgcggctttggagca<br>gctaa | TCR 57 Codon-optimized full sequence with human constant (nt) |
| 403 | ATGGATACCTGGCTCGTATGCTGGGCAATTTTTAGTCTCTTGAAAGCAGGACTCACAGAACC<br>TGAAGTCACCCAGACTCCCAGCCATCAGGTCACACAGATGGGACAGGAAGTGATCTTGCGCT<br>GTGTCCCCATCTCTAATCACTTATACTTCTATTGGTACAGACAAATCTTGGGCAGAAAGTC<br>GAGTTTCTGGTTTCCTTTTATAATAATGAAATCTCAGAGAAGTCTGAAATATTCGATGATCA<br>ATTCTCAGTTGAAAGGCCTGATGGATCAAATTTCACTCTGAAGATCCGGTCCACAAAGCTGG<br>AGGACTCAGCCATGTACTTCTGTGCCAGCACCCCCGAAGCTCCTACGAGCAGTACTTCGGG<br>CCGGGCACCAGGCTCACGGTCACGaagatctgaagaacgtcttcccacctgaggtggccgt<br>gttcgagccttctgaggccgagatcagccacacacagaaagccacactcgtgtgtctggcca<br>ccggcttctatcccgatcacgtggaactgtcttggtgggtcaacggcaaagaggtgcacagc<br>ggcgtctgtaccgatcctcagcctctgaaagagcagcccgctctgaacgacagcagatactg<br>cctgagcagcagactgagagtgtccgccaccttctggcagaaccccagaaaccacttcagat<br>gccaggtgcagttctacggcctgagcgagaacgatgagtggacccaggatagagccaagcct<br>gtgacacagatcgtgtctgccgaagcctggggcagagccgattgtggctttaccagcgagag<br>ctaccagcagggcgtgctgtctgccacaatcctgtacgagatcctgctgggcaaagccactc<br>tgtacgccgtgctggtgtctgccctggtgctgatggccatggtcaagcggaaggatagcaga<br>ggcggaagcggcgccacaaacttctcactgctgaaacaggctggcgacgtggaggagaatcc<br>tggcccaATGATGATATCCTTGAGAGTTTTACTGGTGATCCTGTGGCTTCAGTTAAGCTGGG<br>TTTGGAGCCAACGGAAGGAGGTGGAGCAGGATCCTGGACCCTTCAATGTTCCAGAGGGAGCC | TCR 58 Native full sequence with human constant (nt) |

| SEQ ID NO | SEQUENCE | Description |
|---|---|---|
| | ACTGTCGCTTTCAACTGTACTTACAGCAACAGTGCTTCTCAGTCTTTCTTCTGGTACAGACA<br>GGATTGCAGGAAAGAACCTAAGTTGCTGATGTCcGTATACTCCAGTGGTAATGAAGATGGAA<br>GGTTTACAGCACAGCTCAATAGAGCCAGCCAGTATATTTCCCTGCTCATCAGAGACTCCAAG<br>CTCAGTGATTCAGCCACCTACCTCTGTGTGGTGAACAGGGATAACTATGGTCAGAATTTTGT<br>CTTTGGTCCCGGAACCAGATTGTCCGTGCTGCCCAATATCCAGAATCCGGACCccgcggtat<br>atcaactgcgcgactcaaaatcatccgataagagtgtctgtttgtttactgacttcgacagt<br>caaactaatgtctctcagagcaaagattccgatgtctacatcactgacaagtgcgttctgga<br>tatgcggagcatggattttaagtccaactccgccgtagcctggtccaacaagtcagactttg<br>cctgtgcaaatgctttcaacaactcaattatccctgaggacactttctttccttcaccggag<br>tcctcatgcgatgttaaactggtcgaaaaatcttttgagacggatacgaacctcaacttcca<br>aaatttgagcgttattggctttaggattctgcttctcaaggttgcggggttcaatctcctga<br>tgacgttgcggctttggagcagctaa | |
| 404 | ATGGATACCTGGCTCGTATGCTGGGCAATTTTTAGTCTCTTGAAAGCAGGACTCACAGAACC<br>TGAAGTCACCCAGACTCCCAGCCATCAGGTCACACAGATGGGACAGGAAGTGATCTTGCGCT<br>GTGTCCCCATCTCTAATCACTTATACTTCTATTGGTACAGACAAATCTTGGGGCAGAAAGTC<br>GAGTTTCTGGTTTCCTTTTATAATAATGAAATCTCAGAGAAGTCTGAAATATTCGATGATCA<br>ATTCTCAGTTGAAAGGCCTGATGGATCAAATTTCACTCTGAAGATCCGGTCCACAAAGCTGG<br>AGGACTCAGCCATGTACTTCTGTGCCTATTCGGGCAGGGCCTCCTACGAGCAGTACTTCGGG<br>CCGGGCACCAGGCTCACGGTCACAgaagatctgaagaacgtcttcccacctgaggtggccgt<br>gttcgagccttctgaggccgagatcagccacacacagaaagccacactcgtgtgtctggcca<br>ccggcttctatcccgatcacgtggaactgtcttggtgggtcaacggcaaagaggtgcacagc<br>ggcgtctgtaccgatcctcagcctctgaaagagcagcccgctctgaacgacagcagatactg<br>cctgagcagcagactgagagtgtccgccaccttctggcagaacccagaaaccacttcagat<br>gccaggtgcagttctacggcctgagcgagaacgatgagtggacccaggatagagccaagcct<br>gtgacacagatcgtgtctgccgaagcctggggcagagccgattgtggctttaccagcgagag<br>ctaccagcagggcgtgctgtctgccacaatcctgtacgagatcctgctgggcaaagccactc<br>tgtacgccgtgctggtgtctgccctggtgctgatggccatggtcaagcggaaggatagcaga<br>ggcggaagcggcgccacaaacttctcactgctgaaacaggctggcgacgtggaggagaatcc<br>tggcccaATGATGATATCCTTGAGAGTTTTACTGGTGATCCTGTGGCTTCAGTTAAGCTGGG<br>TTTGGAGCCAACGGAAGGAGGTGGAGCAGGATCCTGGACCCTTCAATGTTCCAGAGGGAGCC<br>ACTGTCGCTTTCAACTGTACTTACAGCAACAGTGCTTCTCAGTCTTTCTTCTGGTACAGACA<br>GGATTGCAGGAAAGAACCTAAGTTGCTGATGTCcGTATACTCCAGTGGTAATGAAGATGGAA<br>GGTTTACAGCACAGCTCAATAGAGCCAGCCAGTATATTTCCCTGCTCATCAGAGACTCCAAG<br>CTCAGTGATTCAGCCACCTACCTCTGTGTGGTGAACAGGGATAACTATGGTCAGAATTTTGT<br>CTTTGGTCCCGGAACCAGATTGTCCGTGCTGCCCAATATCCAGAATCCGGACCccgcggtat<br>atcaactgcgcgactcaaaatcatccgataagagtgtctgtttgtttactgacttcgacagt<br>caaactaatgtctctcagagcaaagattccgatgtctacatcactgacaagtgcgttctgga<br>tatgcggagcatggattttaagtccaactccgccgtagcctggtccaacaagtcagactttg<br>cctgtgcaaatgctttcaacaactcaattatccctgaggacactttctttccttcaccggag<br>tcctcatgcgatgttaaactggtcgaaaaatcttttgagacggatacgaacctcaacttcca<br>aaatttgagcgttattggctttaggattctgcttctcaaggttgcggggttcaatctcctga<br>tgacgttgcggctttggagcagctaa | TCR 59 Native full sequence with human constant (nt) |
| 405 | ATGGATACCTGGCTCGTATGCTGGGCAATTTTTAGTCTCTTGAAAGCAGGACTCACAGAACC<br>TGAAGTCACCCAGACTCCCAGCCATCAGGTCACACAGATGGGACAGGAAGTGATCTTGCGCT<br>GTGTCCCCATCTCTAATCACTTATACTTCTATTGGTACAGACAAATCTTGGGGCAGAAAGTC<br>GAGTTTCTGGTTTCCTTTTATAATAATGAAATCTCAGAGAAGTCTGAAATATTCGATGATCA<br>ATTCTCAGTTGAAAGGCCTGATGGATCAAATTTCACTCTGAAGATCCGGTCCACAAAGCTGG<br>AGGACTCAGCCATGTACTTCTGTGCCATCAGTCGGACAGTCTCCTACGAGCAGTACTTCGGG<br>CCGGGCACCAGGCTCACGGTCACAgaagatctgaagaacgtcttcccacctgaggtggccgt<br>gttcgagccttctgaggccgagatcagccacacacagaaagccacactcgtgtgtctggcca<br>ccggcttctatcccgatcacgtggaactgtcttggtgggtcaacggcaaagaggtgcacagc<br>ggcgtctgtaccgatcctcagcctctgaaagagcagcccgctctgaacgacagcagatactg<br>cctgagcagcagactgagagtgtccgccaccttctggcagaacccagaaaccacttcagat<br>gccaggtgcagttctacggcctgagcgagaacgatgagtggacccaggatagagccaagcct<br>gtgacacagatcgtgtctgccgaagcctggggcagagccgattgtggctttaccagcgagag<br>ctaccagcagggcgtgctgtctgccacaatcctgtacgagatcctgctgggcaaagccactc<br>tgtacgccgtgctggtgtctgccctggtgctgatggccatggtcaagcggaaggatagcaga<br>ggcggaagcggcgccacaaacttctcactgctgaaacaggctggcgacgtggaggagaatcc<br>tggcccaATGATGAAATCCTTGAGAGTTTTACTAGTGATCCTGTGGCTTCAGTTGAGCTGGG<br>TTTGGAGCCAACAGAAGGAGGTGGAGCAGAATTCTGGACCCCTCAGTGTTCCAGAGGGAGCC<br>ATTGCCTCTCTCAACTGCACTTACAGTGACCGAGGTTCCCAGTCCTTCTTCTGGTACAGACA<br>ATATTCTGGGAAAAGCCCTGAGTTGATAATGTTCATATACTCCAATGGTGACAAAGAAGATG<br>GAAGGTTTACAGCACAGCTCAATAAAGCCAGCCAGTATGTTTCTCTGCTCATCAGAGACTCC<br>CAGCCCAGTGATTCAGCCACCTACCTCTGTGCCGTGAACATGTTGGGGAGTGGAGGTAGCAA<br>CTATAAACTGACATTTGGAAAAGGAACTCTCTTAACCGTGAATCCAAATATCCAGAATCCGG<br>ACCccgcggtatatcaactgcgcgactcaaaatcatccgataagagtgtctgtttgtttact<br>gacttcgacagtcaaactaatgtctctcagagcaaagattccgatgtctacatcactgacaa<br>gtgcgttctggatatgcggagcatggattttaagtccaactccgccgtagcctggtccaaca<br>agtcagactttgcctgtgcaaatgctttcaacaactcaattatccctgaggacactttcttt | TCR 60 Native full sequence with human constant (nt) |

SEQUENCE TABLE

| SEQ ID NO | SEQUENCE | Description |
|---|---|---|
| | ccttcaccggagtcctcatgcgatgttaaactggtcgaaaaatcttttgagacggatacgaa<br>cctcaacttccaaaatttgagcgttattggctttaggattctgcttctcaaggttgcggggt<br>tcaatctcctgatgacgttgcggctttggagcagctaa | |
| 406 | ATGGATACCTGGCTCGTATGCTGGGCAATTTTTAGTCTCTTGAAAGCAGGACTCACAGAACC<br>TGAAGTCACCCAGACTCCCAGCCATCAGGTCACACAGATGGGACAGGAAGTGATCTTGCGCT<br>GTGTCCCCATCTCTAATCACTTATACTTCTATTGGTACAGACAAATCTTGGGGCAGAAAGTC<br>GAGTTTCTGGTTTCCTTTTATAATAATGAAATCTCAGAGAAGTCTGAAATATTCGATGATCA<br>ATTCTCAGTTGAAAGGCCTGATGGATCAAATTTCACTCTGAAGATCCGGTCCACAAAGCTGG<br>AGGACTCAGCCATGTACTTCTGTGCCAGCACCAAACGTTTTAGCTACGAGCAGTACTTCGGG<br>CCGGGCACCAGGCTCACGGTCACAgaagatctgaagaacgtcttcccacctgaggtggccgt<br>gttcgagccttctgaggccgagatcagccacacacagaaagccacactcgtgtgtctggcca<br>ccggcttctatcccgatcacgtggaactgtcttggtgggtcaacggcaaagaggtgcacagc<br>ggcgtctgtaccgatcctcagcctctgaaagagcagcccgctctgaacgacagcagatactg<br>cctgagcagcagactgagagtgtccgccaccttctggcagaacccagaaaccacttcagat<br>gccaggtgcagttctacggcctgagcgagaacgatgagtggaccccaggatagagccaagcct<br>gtgacacagatcgtgtctgccgaagcctggggcagagccgattgtggctttaccagcgagag<br>ctaccagcagggcgtgctgtctgccacaatcctgtacgagatcctgctgggcaaagccactc<br>tgtacgccgtgctggtgtctgccctggtgctgatggccatggtcaagcggaaggatagcaga<br>ggcggaagcggcgccacaaaacttctcactgctgaaacaggctggcgacgtggaggagaatcc<br>tgggcccaATGATGAAATCCTTGAGAGTTTTACTAGTGATCCTGTGGCTTCAGTTGAGCTGGG<br>TTTGGAGCCAACAGAAGGAGGTGGAGCAGAATTCTGGACCCCTCAGTGTTCCAGAGGGAGCC<br>ATTGCCTCTCTCAACTGCACTTACAGTGACCGAGGTTCCCAGTCCTTCTTCTGGTACAGACA<br>ATATTCTGGGAAAAGCCCTGAGTTGATAATGTTCATATACTCCAATGGTGACAAAGAAGATG<br>GAAGGTTTACAGCACAGCTCAATAAAGCCAGCCAGTATGTTTCTCTGCTCATCAGAGACTCC<br>CAGCCCAGTGATTCAGCCACCTACCTCTGTGCCGTGAACATAGAGAATAACAATGCCAGACT<br>CATGTTTGGAGATGGAACTCAGCTGGTGGTGAAGCCCAATATCCAGAATCCGGACCccgcgg<br>tatatcaactgcgcgactcaaaatcatccgataagagtgtctgtttgtttactgacttcgac<br>agtcaaactaatgtctctcagagcaaagattccgatgtctacatcactgacaagtgcgttct<br>ggatatgcggagcatggattttaagtccaactccgccgtagcctggtccaacaagtcagact<br>ttgcctgtgcaaatgctttcaacaactcaattatccctgaggacactttctttccttcaccg<br>gagtcctcatgcgatgttaaactggtcgaaaaatcttttgagacggatacgaacctcaactt<br>ccaaaatttgagcgttattggctttaggattctgcttctcaaggttgcggggttcaatctcc<br>tgatgacgttgcggctttggagcagctaa | TCR 61 Native full sequence with human constant (nt) |
| 407 | ATGGGCACCAGGCTCCTCTGCTGGGCGGCCCTCTGTCTCCTGGGAGCAGAACTCACAGAAGC<br>TGGAGTTGCCCAGTCTCCCAGATATAAGATTATAGAGAAAAGGCAGAGTGTGGCTTTTTGGT<br>GCAATCCTATATCTGGCCATGCTACCCTTTACTGGTACCAGCAGATCCTGGGACAGGGCCCA<br>AAGCTTCTGATTCAGTTTCAGAATAACGGTGTAGTGGATGATTCACAGTTGCCTAAGGATCG<br>ATTTTCTGCAGAGAGGCTCAAAGGAGTAGACTCCACTCTCAAGATCCAgCCTGCAAAGCTTG<br>AGGACTCGGCCGTGTATCTCTGTGCCAGCAGCTTAGATACCCGGGGCTCCTCCTACAATGAG<br>CAGTTCTTCGGGCCAGGGACACGGCTCACCGTGCTAgaagatctgaagaacgtcttcccacc<br>tgaggtggccgtgttcgagccttctgaggccgagatcagccacacacagaaagccacactcg<br>tgtgtctggccaccggcttctatcccgatcacgtggaactgtcttggtgggtcaacggcaaa<br>gaggtgcacagcggcgtctgtaccgatcctcagcctctgaaagagcagcccgctctgaacga<br>cagcagatactgcctgagcagcagactgagagtgtccgccaccttctggcagaacccagaa<br>accacttcagatgccaggtgcagttctacggcctgagcgagaacgatgagtggacccaggat<br>agagccaagcctgtgacacagatcgtgtctgccgaagcctggggcagagccgattgtggctt<br>taccagcgagagctaccagcagggcgtgctgtctgccacaatcctgtacgagatcctgctgg<br>gcaaagccactctgtacgccgtgctggtgtctgccctggtgctgatggccatggtcaagcgg<br>aaggatagcagaggcggaagcggcgccacaaacttctcactgctgaaacaggctggcgacgt<br>ggaggagaatcctggcccaATGACACGAGTTAGCTTGCTGTGGGCAGTCGTGGTCTCCACCT<br>GTCTTGAATCCGGCATGGCCCAGACAGTCACTCAGTCTCAACCAGAGATGTCTGTGCAGGAG<br>GCAGAGACTGTGACCCTGAGTTGCACATATGACACCAGTGAGAATAATTATTATTTGTTCTG<br>GTACAAGCAGCCTCCCAGCAGGCAGATGATTCTCGTTATTCGCCAAGAAGCTTATAAGCAAC<br>AGAATGCAACGGAGAATCGTTTCTCTGTGAACTTCCAGAAAGCAGCCAAATCCTTCAGTCTC<br>AAGATCTCAGACTCACAGTCTGGGGACACTGCGATGTATTTCTGTGCTCTCTATACCTACAA<br>ATACATCTTTGGAACAGGCACCAGGCTGAAGGTTTTAGCAAATATCCAGAATCCGGACCccg<br>cggtatatcaactgcgcgactcaaaatcatccgataagagtgtctgtttgtttactgacttc<br>gacagtcaaactaatgtctctcagagcaaagattccgatgtctacatcactgacaagtgcgt<br>tctggatatgcggagcatggattttaagtccaactccgccgtagcctggtccaacaagtcag<br>actttgcctgtgcaaatgctttcaacaactcaattatccctgaggacactttctttccttca<br>ccggagtcctcatgcgatgttaaactggtcgaaaaatcttttgagacggatacgaacctcaa<br>cttccaaaatttgagcgttattggctttaggattctgcttctcaaggttgcggggttcaatc<br>tcctgatgacgttgcggctttggagcagctaa | TCR 62 Native full sequence with human constant (nt) |
| 408 | ATGGGCACCAGGCTCCTCTGCTGGGTGGTCCTGGGTTTCCTAGGGACAGATCACACAGGTGC<br>TGGAGTCTCCCAGTCCCTAGGTACAAAGTCGCAAAGAGAGGACAGGATGTAGCTCTCAGGT<br>GTGATCCAATTTCGGGTCATGTATCCCTTTTTTGGTACCAACAGGCCCTGGGGCAGGGGCCA<br>GAGTTTCTGACTTATTTCCAGAATGAAGCTCAACTAGACAAATCGGGGCTGCCCAGTGATCG<br>CTTCTTTGCAGAAAGGCCTGAGGGATCCGTCTCCACTCTGAAGATCCAGCGCACACAGCAGG<br>AGGACTCCGCCGTGTATCTCTGTGCCAGCAGACCAAGACAGGGGTATAATGACAATGAGCAG<br>TTCTTCGGGCCAGGGACACGGCTCACCGTGCTAgaagatctgaagaacgtcttcccacctga | TCR 63 Native full sequence with human constant (nt) |

SEQUENCE TABLE

| SEQ ID NO | SEQUENCE | Description |
|---|---|---|
| | ggtggccgtgttcgagccttctgaggccgagatcagccacacacagaaagccacactcgtgt<br>gtctggccaccggcttctatcccgatcacgtggaactgtcttggtgggtcaacggcaaagag<br>gtgcacagcggcgtctgtaccgatcctcagcctctgaaagagcagcccgctctgaacgacag<br>cagatactgcctgagcagcagactgagagtgtccgccaccttctggcagaaccccagaaacc<br>acttcagatgccaggtgcagttctacggcctgagcgagaacgatgagtggacccaggataga<br>gccaagcctgtgacacagatcgtgtctgccgaagcctggggcagagccgattgtggctttac<br>cagcgagagctaccagcagggcgtgctgtctgccacaatcctgtacgagatcctgctgggca<br>aagccactctgtacgccgtgctggtgtctgccctggtgctgatggccatggtcaagcggaag<br>gatagcagaggcggaagcggcgccacaaacttctcactgctgaaacaggctggcgacgtgga<br>ggagaatcctggcccaATGGAGACTGTTCTGCACGTACTCCTAGGGATATTGGGGTTCCAAG<br>CAGCCTGGGTCAGTAGCCAAGAACTGGAGCAGAGTCCTCAGTCCTTGATCGTCCAAGAGGGA<br>AAGAATCTCACCATAAACTGCACGTCATCAAAGACGTTATATGGCTTATACTGGTATAAGCA<br>AAAGTATGGTGAAGGTCTTATCTTCTTGATGATGCTACAGAAAGGTGGGGAAGAGAAAAGTC<br>ATGAAAAGATAACTGCCAAGTTGGATGAGAAAAAGCAGCAAAGTTCCCTGCATATCACAGCC<br>TCCCAGCCCAGCCATGCAGGCATCTACCTCTGTGGAGCAGACATAGACGACTACAAGCTCAG<br>CTTTTGGAGCCGGAACCACAGTAACTGTAAGAGCAAATATCCGGACCCcgcgctat<br>atcaactgcgcgactcaaaatcatccgataagagtgtctgtttgtttactgacttcgacagt<br>caaactaatgtctctcagagcaaagattccgatgtctacatcactgacaagtgcgttctgga<br>tatgcggagcatggattttaagtccaactccgcgtagcctggtccaacaagtcagactttg<br>cctgtgcaaatgctttcaacaactcaattatccctgaggacactttctttccttcaccggag<br>tcctcatgcgatgttaaactggtcgaaaaatcttttgagacggatacgaacctcaacttcca<br>aaatttgagcgttattggctttaggattctgcttctcaaggttgcggggttcaatctcctga<br>tgacgttgcggctttggagcagctaa | |
| 409 | ATGGGCTGCAGGCTCCTCTGCTGTGTGGTCTTCTGCCTCCTCCAAGCAGGTCCCTTGGACAC<br>AGCTGTTTCCCAGACTCCAAAATACCTGGTCACACAGATGGGAAACGACAAGTCCATTAAAT<br>GTGAACAAAATCTGGGCCATGATACTATGTATTGGTATAAACAGGACTCTAAGAAATTTCTG<br>AAGATAATGTTTAGCTACAATAATAAGGAGCTCATTATAAATGAAACAGTTCCAAATCGCTT<br>CTCACCTAAATCTCCAGACAAAGCTCACTTAAATCTTCACATCAATTCCCTGGAGCTTGGTG<br>ACTCTGCTGTGTATTTCTGTGCCAGCAGCCAGGGGAAGCTGGGGCAACGTCCTGACTTTC<br>GGGGCCGGCAGCAGGCTGACCGTGCTGgaagatctgaagaacgtcttcccacctgaggtggc<br>cgtgttcgagccttctgaggccgagatcagccacacacagaaagccacactcgtgtgtctgg<br>ccaccggcttctatcccgatcacgtggaactgtcttggtgggtcaacggcaaagaggtgcac<br>agcggcgtctgtaccgatcctcagcctctgaaagagcagcccgctctgaacgacagcagata<br>ctgcctgagcagcagactgagagtgtccgccaccttctggcagaaccccagaaaccacttca<br>gatgccaggtgcagttctacggcctgagcgagaacgatgagtggacccaggatagagccaag<br>cctgtgacacagatcgtgtctgccgaagcctggggcagagccgattgtggctttaccagcga<br>gagctaccagcagggcgtgctgtctgccacaatcctgtacgagatcctgctgggcaaagcca<br>ctctgtacgccgtgctggtgtctgccctggtgctgatggccatggtcaagcggaaggatagc<br>agaggcggaagcggcgccacaaacttctcactgctgaaacaggctggcgacgtggaggagaa<br>tcctggcccaATGAACATGCTGACTGCCAGCCTGTTGAGGGCAGTCATAGCCTCCATCTGTG<br>TTGTATCCAGCATGGCTCAGAAGGTAACTCAAGCGCAGACTGAAATTTCTGTGGTGGAGAAG<br>GAGGATGTGACCTTGGACTGTGTGTATGAAACCCGTGATACTACTTATTACTTATTCTGGTA<br>CAAGCAACCACCAAGTGGAGAATTGGTTTTCCTTATTCGTCGGAACTCTTTTGATGAGCAAA<br>ATGAAATAAGTGGTCGGTATTCTTGGAACTTCCAGAAATCCACCAGTTCCTTCAACTTCACC<br>ATCACAGCCTCACAAGTCGTGGACTCAGCAGTATACTTCTGTGCTCTGAGTGGGGTCGATAA<br>CTATGGTCAGAATTTTGTCTTTGGTCCCGGAACCAGATTGTCCGTGCTGCCCAATATCCAGA<br>ATCCGGACCcgcggtatatcaactgcgcgactcaaaatcatccgataagagtgtctgtttg<br>tttactgacttcgacagtcaaactaatgtctctcagagcaaagattccgatgtctacatcac<br>tgacaagtgcgttctggatatgcggagcatggattttaagtccaactccgcgtagcctggt<br>ccaacaagtcagactttgcctgtgcaaatgctttcaacaactcaattatccctgaggacact<br>ttctttccttcaccggagtcctcatgcgatgttaaactggtcgaaaaatcttttgagacgga<br>tacgaacctcaacttccaaaatttgagcgttattggctttaggattctgcttctcaaggttg<br>cggggttcaatctcctgatgacgttgcggctttggagcagctaa | TCR 64 Native full sequence with human constant (nt) |
| 410 | ATGGGAATCAGGCTCCTCTGTCGTGTGGCCTTTTGTTTCCTGGCTGTAGGCCTCGTAGATGT<br>GAAAGTAACCCAGAGCTCGAGATATCTAGTCAAAAGGACGGGAGAGAAAGTTTTTCTGGAAT<br>GTGTCCAGGATATGGACCATGAAAATATGTTCTGGTATCGACAAGACCCAGGTCTGGGGCTA<br>CGGCTGATCTATTTCTCATATGATGTTAAAATGAAAGAAAAAGGAGATATTCCTGAGGGGTA<br>CAGTGTCTCTAGAGAGAAGAAGGAGCGCTTCTCCCTGATTCTGGAGTCCGCCAGCACCAACC<br>AGACATCTATGTACCTCTGTGCCAGCAGTTTATGGGACGGCGAAACACCGGGGAGCTGTTT<br>TTTGGAGAAGGCTCTAGGCTGACCGTACTGgaagatctgaagaacgtcttcccacctgaggt<br>ggccgtgttcgagccttctgaggccgagatcagccacacacagaaagccacactcgtgtgtc<br>tggccaccggcttctatcccgatcacgtggaactgtcttggtgggtcaacggcaaagaggtg<br>cacagcggcgtctgtaccgatcctcagcctctgaaagagcagcccgctctgaacgacagcag<br>atactgcctgagcagcagactgagagtgtccgccaccttctggcagaaccccagaaaccact<br>tcagatgccaggtgcagttctacggcctgagcgagaacgatgagtggacccaggatagagcc<br>aagcctgtgacacagatcgtgtctgccgaagcctggggcagagccgattgtggctttaccag<br>cgagagctaccagcagggcgtgctgtctgccacaatcctgtacgagatcctgctgggcaaag<br>ccactctgtacgccgtgctggtgtctgccctggtgctgatggccatggtcaagcggaaggat<br>agcagaggcggaagcggcgccacaaacttctcactgctgaaacaggctggcgacgtggagga<br>gaatcctggcccaATGGAGAAAATGTTGGAGTGTGCATTCATAGTCTTGTGGCTTCAGCTTG<br>GCTGGTTGAGTGGAGAAGACCAGGTGACGCAGAGTCCCGAGGCCCTGAGACTCCAGGAGGGA | TCR 65 Native full sequence with human constant (nt) |

| SEQ ID NO | SEQUENCE | Description |
|---|---|---|
| | GAGAGTAGCAGTCTtAACTGCAGTTACACAGTCAGCGGTTTAAGAGGGCTGTTCTGGTATAG GCAAGATCCTGGGAAAGGCCCTGAATTCCTCTTCACCCTGTATTCAGCTGGGGAAGAAAGG AGAAAGAAAGGCTAAAAGCCACATTAACAAAGAAGGAAAGCTTTCTGCACATCACAGCCCCT AAACCTGAAGACTCAGCCACTTATCTCTGTGCTGTGCAGGCAGAAAGAGGCTCAACCCTGGG GAGGCTATACTTTGGAAGAGGAACTCAGTTGACTGTCTGGCCTAATATCCAGAATCCGGACC ccgcggtatatcaactgcgcgactcaaaatcatccgataagagtgtctgtttgtttactgac ttcgacagtcaaactaatgtctctcagagcaaagattccgatgtctacatcactgacaagtg cgttctggatatgcggagcatggatttttaagtccaactccgccgtagcctggtccaacaagt cagactttgcctgtgcaaatgctttcaacaactcaattatccctgaggacactttctttcct tcaccggagtcctcatgcgatgttaaactggtcgaaaaatcttttgagacggatacgaacct caacttccaaaatttgagcgttattggctttaggattctgcttctcaaggttgcggggttca atctcctgatgacgttgcggctttggagcagctaa | |
| 411 | ATGGCCAACTCTGCTATGGACACCAGAGTACTCTGCTGTGCGGTCATCTGTCTTCTGGGGGC AGGTCTCTCAAATGCCGGCGTCATGCAGAACCCAAGACACCTGGTCAGGAGGAGGGGACAGG AGGCAAGACTGAGATGCAGCCCAATGAAAGGACACAGTCATGTTTACTGGTATCGGCAGCTC CCAGAGGAAGGTCTGAAATTCATGGTTTATCTCCAGAAAGAAAATATCATAGATGAGTCAGG AATGCCAAAGGAACGATTTTCTGCTGAATTTCCCAAAGAGGGCCCCAGCATCCTGAGGATCC AGCAGGTAGTGCAGGAGATTCGGCAGCTTATTTCTGTGCCAGCTCACCAGACGAAAGCAGG GATAGCAATCAGCCCCAGCATTTTGGTGATGGACTCGACTCTCCATCCTAgaagatctgaa gaacgtcttcccacctgaggtggccgtgttcgagccttctgaggccgagatcagccacacac agaaagccacactcgtgtgtctggccaccggcttctatcccgatcacgtggaactgtcttgg tgggtcaacggcaaagaggtgcacagcggcgtctgtaccgatcctcagcctctgaaagagca gcccgctctgaacgacagcagatactgcctgagcagcagactgagagtgtccgccaccttct ggcagaaccccagaaaccacttcagatgccaggtgcagttctacggcctgagcgagaacgat gagtggacccaggatagagccaagcctgtgacacagatcgtgtctgccgaagcctggggcag agccgattgtggctttaccagcgagagctaccagcagggcgtgctgtctgccacaatcctgt acgagatcctgctgggcaaagccactctgtacgccgtgctggtgtctgccctggtgctgatg gccatggtcaagcggaaggatagcagaggc | TCR 56 Native full sequence with human constant (nt) |
| 412 | atgggacccatggccaatagcgccatggataccagagtgctgtgctgcgccgtgatctgtct gcttggagccggactgtctaatgccggcgtgatgcagaaacccagacacctcgttcggagaa gaggccaagaggccagactgagatgcagccctatgaagggccacagccacgtgactggtac agacagctgcctgaagagggcctgaagttcatggtgtacctgcagaaagagaacatcatcga cgagagcggcatgcccaaagagcggttctctgccgagtttcccaaagagggccccagcatcc tgagaatccagcaggttgtgcgggagatagccgccgcctactttttgtgccagctctcccgat gagagccgggactctaatcagcctcagcacttttgcgacggcaccaggctgtctattctcga agatctgaagaacgtcttcccacctgaggtggccgtgttcgagccttctgaggccgagatca gccacacacagaaagccacactcgtgtgtctggccaccggcttctatcccgatcacgtggaa ctgtcttggtgggtcaacggcaaagaggtgcacagcggcgtctgtaccgatcctcagcctct gaaagagcagcccgctctgaacgacagcagatactgcctgagcagcagactgagagtgtccg ccaccttctggcagaaccccagaaaccacttcagatgccaggtgcagttctacggcctgagc gagaacgatgagtggacccaggatagagccaagcctgtgacacagatcgtgtctgccgaagc ctgggcagagccgattgtggctttaccagcgagagctaccagcagggcgtgctgtctgcca caatcctgtacgagatcctgctgggcaaagccactctgtacgccgtgctggtgtctgccctg gtgctgatggccatggtcaagcggaaggatagcagaggc | TCR 56 Codon-optimized full sequence with human constant (nt) |
| 413 | ATGCTCCTGCTGCTTCTGCTCCTCGGGCCCGGCAGCGGTCTCGGCGCCGTCGTGTCGCAGCA CCCGTCGTGGGTGATTTGCAAGAGCGGAACGAGCGTGAAGATCGAGTGCCGCTCGCTGACT TCCAGGCCACAACCATGTTCTGGTACCGCCAGTTTCCCAAGCAGAGCCTCATGCTGATGGCC ACAAGCAATGAAGGCAGCAAGGCCACTTATGAACAGGGCGTGGAGAAGGACAAGTTTCTGAT CAACCACGCCTCCCTGACCCTGTCCACCCTCACTGTGACCAGCGCCCACCCTGAGGACAGCA GCTTCTACATCTGCAGCGCCCGCAGCTGGAGGGGCGGCCTGGCAGTTCTTCGGCCCTGGC ACCCGGCTGACAGTGCTGgaagatctgaagaacgtcttcccacctgaggtggccgtgttcga gccttctgaggccgagatcagccacacacagaaagccacactcgtgtgtctggccaccggct tctatcccgatcacgtggaactgtcttggtgggtcaacggcaaagaggtgcacagcggcgtc tgtaccgatcctcagcctctgaaagagcagcccgctctgaacgacagcagatactgcctgag cagcagactgagagtgtccgccaccttctggcagaaccccagaaaccacttcagatgccagg tgcagttctacggcctgagcgagaacgatgagtggacccaggatagagccaagcctgtgaca cagatcgtgtctgccgaagcctgggcagagccgattgtggctttaccagcgagagctacca gcagggcgtgctgtctgccacaatcctgtacgagatcctgctgggcaaagccactctgtacg ccgtgctggtgtctgccctggtgctgatggccatggtcaagcggaaggatagcagaggc | TCR 57 Codon-optimized full sequence with human constant (nt) |
| 414 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGCAGAAAGTC GAGTTTCTGGTTTCCTTTTATAATAATGAAATCTCAGAGAGTTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCAGCACCCCCGAAGCTCCTACGAGCAGTACTTCGGG CCGGGCACCAGGCTCACGGTCACAgaagatctgaagaacgtcttcccacctgaggtggccgt gttcgagccttctgaggccgagatcagccacacacagaaagccacactcgtgtgtctggcca ccggcttctatcccgatcacgtggaactgtcttggtgggtcaacggcaaagaggtgcacagc ggcgtctgtaccgatcctcagcctctgaaagagcagcccgctctgaacgacagcagatactg | TCR 58 Native full sequence with human constant (nt) |

SEQUENCE TABLE

| SEQ ID NO | SEQUENCE | Description |
|---|---|---|
| | cctgagcagcagactgagagtgtccgccaccttctggcagaacccagaaaccacttcagat gccaggtgcagttctacggcctgagcgagaacgatgagtggacccaggatagagccaagcct gtgacacagatcgtgtctgccgaagcctggggcagagccgattgtggctttaccagcgagag ctaccagcagggcgtgctgtctgccacaatcctgtacgagatcctgctgggcaaagccactc tgtacgccgtgctggtgtctgccctggtgctgatggccatggtcaagcggaaggatagcaga ggc | |
| 415 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCTATTCGGGCAGGGCCTCCTACGAGCAGTACTTCGGG CCGGGCACCAGGCTCACGGTCACAgaagatctgaagaacgtcttcccacctgaggtggccgt gttcgagccttctgaggccgagatcagccacacacagaaagccacactcgtgtgtctggcca ccggcttctatcccgatcacgtggaactgtcttggtgggtcaacggcaaagaggtgcacagc ggcgtctgtaccgatcctcagcctctgaaagagcagcccgctctgaacgacagcagatactg cctgagcagcagactgagagtgtccgccaccttctggcagaacccagaaaccacttcagat gccaggtgcagttctacggcctgagcgagaacgatgagtggacccaggatagagccaagcct gtgacacagatcgtgtctgccgaagcctggggcagagccgattgtggctttaccagcgagag ctaccagcagggcgtgctgtctgccacaatcctgtacgagatcctgctgggcaaagccactc tgtacgccgtgctggtgtctgccctggtgctgatggccatggtcaagcggaaggatagcaga ggc | TCR 59 Native full sequence with human constant (nt) |
| 416 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCATCAGTCGGACAGTCTCCTACGAGCAGTACTTCGGG CCGGGCACCAGGCTCACGGTCACAgaagatctgaagaacgtcttcccacctgaggtggccgt gttcgagccttctgaggccgagatcagccacacacagaaagccacactcgtgtgtctggcca ccggcttctatcccgatcacgtggaactgtcttggtgggtcaacggcaaagaggtgcacagc ggcgtctgtaccgatcctcagcctctgaaagagcagcccgctctgaacgacagcagatactg cctgagcagcagactgagagtgtccgccaccttctggcagaacccagaaaccacttcagat gccaggtgcagttctacggcctgagcgagaacgatgagtggacccaggatagagccaagcct gtgacacagatcgtgtctgccgaagcctggggcagagccgattgtggctttaccagcgagag ctaccagcagggcgtgctgtctgccacaatcctgtacgagatcctgctgggcaaagccactc tgtacgccgtgctggtgtctgccctggtgctgatggccatggtcaagcggaaggatagcaga ggc | TCR 60 Native full sequence with human constant (nt) |
| 417 | ATGGATACCTGGCTCGTATGCTGGGCAATTTTTAGTCTCTTGAAAGCAGGACTCACAGAACC TGAAGTCACCCAGACTCCCAGCCATCAGGTCACACAGATGGGACAGGAAGTGATCTTGCGCT GTGTCCCCATCTCTAATCACTTATACTTCTATTGGTACAGACAAATCTTGGGGCAGAAAGTC GAGTTTCTGGTTTCCTTTTATAATAATGAAATCTCAGAGAAGTCTGAAATATTCGATGATCA ATTCTCAGTTGAAAGGCCTGATGGATCAAATTTCACTCTGAAGATCCGGTCCACAAAGCTGG AGGACTCAGCCATGTACTTCTGTGCCAGCACCAAACGTTTTAGCTACGAGCAGTACTTCGGG CCGGGCACCAGGCTCACGGTCACAgaagatctgaagaacgtcttcccacctgaggtggccgt gttcgagccttctgaggccgagatcagccacacacagaaagccacactcgtgtgtctggcca ccggcttctatcccgatcacgtggaactgtcttggtgggtcaacggcaaagaggtgcacagc ggcgtctgtaccgatcctcagcctctgaaagagcagcccgctctgaacgacagcagatactg cctgagcagcagactgagagtgtccgccaccttctggcagaacccagaaaccacttcagat gccaggtgcagttctacggcctgagcgagaacgatgagtggacccaggatagagccaagcct gtgacacagatcgtgtctgccgaagcctggggcagagccgattgtggctttaccagcgagag ctaccagcagggcgtgctgtctgccacaatcctgtacgagatcctgctgggcaaagccactc tgtacgccgtgctggtgtctgccctggtgctgatggccatggtcaagcggaaggatagcaga ggc | TCR 61 Native full sequence with human constant (nt) |
| 418 | ATGGGCACCAGGCTCCTCTGCTGGGCGGCCCTCTGTCTCCTGGGAGCAGAACTCACAGAAGC TGGAGTTGCCCAGTCTCCCAGATATAAGATTATAGAGAAAAGGCAGAGTGTGGCTTTTTGGT GCAATCCTATATCTGGCCATGCTACCCTTTACTGGTACCAGCAGATCCTGGGACAGGGCCCA AAGCTTCTGATTCAGTTTCAGAATAACGGTGTAGTGGATGATTCACAGTTGCCTAAGGATCG ATTTTCTGCAGAGAGGCTCAAAGGAGTAGACTCCACTCTCAAGATCCAgCCTGCAAAGCTTG AGGACTCGGCCGTGTATCTCTGTGCCAGCAGCTTAGATACCCGGGGCTCCTCCTACAATGAG CAGTTCTTCGGGCCAGGGACACGGCTCACCGTGCTAgaagatctgaagaacgtcttcccacc tgaggtggccgtgttcgagccttctgaggccgagatcagccacacacagaaagccacactcg tgtgtctggccaccggcttctatcccgatcacgtggaactgtcttggtgggtcaacggcaaa gaggtgcacagcggcgtctgtaccgatcctcagcctctgaaagagcagcccgctctgaacga cagcagatactgcctgagcagcagactgagagtgtccgccaccttctggcagaacccagaa accacttcagatgccaggtgcagttctacggcctgagcgagaacgatgagtggacccaggat agagccaagcctgtgacacagatcgtgtctgccgaagcctggggcagagccgattgtggctt | TCR 62 Native full sequence with human constant (nt) |

SEQUENCE TABLE

| SEQ ID NO | SEQUENCE | Description |
|---|---|---|
| | taccagcgagagctaccagcagggcgtgctgtctgccacaatcctgtacgagatcctgctgg gcaaagccactctgtacgccgtgctggtgtctgccctggtgctgatggccatggtcaagcgg aaggatagcagaggc | |
| 419 | ATGGGCACCAGGCTCCTCTGCTGGGTGGTCCTGGGTTTCCTAGGGACAGATCACACAGGTGC TGGAGTCTCCCAGTCCCCTAGGTACAAAGTCGCAAAGAGAGGACAGGATGTAGCTCTCAGGT GTGATCCAATTTCGGGTCATGTATCCCTTTTTTGGTACCAACAGGCCCTGGGGCAGGGGCCA GAGTTTCTGACTTATTTCCAGAATGAAGCTCAACTAGACAAATCGGGGCTGCCCAGTGATCG CTTCTTTGCAGAAAGGCCTGAGGGATCCGTCTCCACTCTGAAGATCCAGCGCACACAGCAGG AGGACTCCGCCGTGTATCTCTGTGCCAGCAGACCAAGACAGGGGTATAATGACAATGAGCAG TTCTTCGGGCCAGGGACACGGCTCACCGTGCTAgaagatctgaagaacgtcttcccacctga ggtggccgtgttcgagccttctgaggccgagatcagccacacacagaaagccacactcgtgt gtctggccaccggcttctatcccgatcacgtggaactgtcttggtgggtcaacggcaaagag gtgcacagcggcgtctgtaccgatcctcagcctctgaaagagcagcccgctctgaacgacag cagatactgcctgagcagcagactgagagtgtccgccaccttctggcagaaccccagaaacc acttcagatgccaggtgcagttctacgcctgagcgagaacaatgagtggaccaggataga gccaagcctgtgacacagatcgtgtctgccgaagcctggggcagagccgattgtggctttac cagcgagagctaccagcagggcgtgctgtctgccacaatcctgtacgagatcctgctgggca aagccactctgtacgccgtgctggtgtctgccctggtgctgatggccatggtcaagcggaag gatagcagaggc | TCR 63 Native full sequence with human constant (nt) |
| 420 | ATGGCTCAAGAGCTGGGCATGCAGTGTCAGGCCAGAGGAATCCTGCAGCAGATGTGGGGAGT GTTCCTGCTGTACGTGTCCATGAAGATGGGCGGCACCACCGGCCAGAACATCGATCAGCCTA CAGAGATGACCGCCACCGAGGGCGCCATCGTGCAGATCAATTGCACCTACCAGACCAGCGGC TTCAACGGCCTGTTCTGGTATCAGCAGCATGCCGGCGAGGCCCCTACCTTCCTGAGCTACAA TGTGCTGGACGGCCTGGAAGAGAAGGGCAGATTCAGCAGCTTCCTGTCCAGAAGCAAGGGCT ACAGCTACCTGCTGCTGAAAGAACTGCAGATGAAGGACAGCGCCTCCTACCTGTGCGCCGTT AGAGATTGGGGATACGGCGGAGCCACCAACAAGCTGATCTTTGGCACAGGCACACTGCTGGC CGTGCAGCCTAATATCCAGAATCCGGACCccgcggtatatcaactgcgcgactcaaaatcat ccgataagagtgtctgtttgtttactgacttcgacagtcaaactaatgtctctcagagcaaa gattccgatgtctacatcactgacaagtgcgttctggatatgcggagcatggattttaagtc caactccgccgtagcctggtccaacaagtcagactttgcctgtgcaaatgctttcaacaact caattatccctgaggacactttctttccttcaccggagtcctcatgcgatgttaaactggtc gaaaaatcttttgagacggatacgaacctcaacttccaaaattgagcgttattggctttag gattctgcttctcaaggttgcggggttcaatctcctgatgacgttgcggctttggagcagct aa | TCR 56 Alpha Codon-Optimized with Codon Optimized Human Constant (nt) |
| 421 | ATGGCTCAAGAGCTGGGCATGCAGTGTCAGGCCAGAGGAATCCTGCAGCAGATGTGGGGAGT GTTCCTGCTGTACGTGTCCATGAAGATGGGCGGCACCACCGGCCAGAACATCGATCAGCCTA CAGAGATGACCGCCACCGAGGGCGCCATCGTGCAGATCAATTGCACCTACCAGACCAGCGGC TTCAACGGCCTGTTCTGGTATCAGCAGCATGCCGGCGAGGCCCCTACCTTCCTGAGCTACAA TGTGCTGGACGGCCTGGAAGAGAAGGGCAGATTCAGCAGCTTCCTGTCCAGAAGCAAGGGCT ACAGCTACCTGCTGCTGAAAGAACTGCAGATGAAGGACAGCGCCTCCTACCTGTGCGCCGTT AGAGATTGGGGATACGGCGGAGCCACCAACAAGCTGATCTTTGGCACAGGCACACTGCTGGC CGTGCAGCCTaatatccagaatccggagcctgccgtgtaccagctgaaggaccccgagcc aggatagcacccctgtgcctgttcaccgactttgattctcagatcaacgtgcccaagaccatg gagagcggcaccttcatcacagacaagtgcgtgctggatatgaaggccatggacagcaagtc caacgcgccatcgcctggtccaatcagacatctttcacctgccaggatatctttaaggaga caaatgccacctatctcctctgacgtgccatgtgatgccaccctgagagaagagcttc gagaccgacatgaacctgaatttcagaatctgctcgtgatgtcctgattgtcctgctgct gaaggtggccggctttaacctgctgatgaccctgaggctgtggagctcctga | TCR 56 Alpha Codon-Optimized with Codon Optimized Mouse Constant (nt) |
| 422 | atgggacccatggccaatagcgccatggataccagagtgctgtgctgcgccgtgatctgtct gcttggagccggactgtctaatgccggcgtgatgcagaacccagacacctcgttcggagaa gaggccaagaggccagactgagatgcagccctatgaagggccacagccacgtgtactggtac agacagctgcctgaagagggcctgaagttcatggtgtacctgcagaaagagaacatcatcga cgagagcggcatgcccaaagagcggttctctgccgagtttcccaaagagggccccagcatcc tgagaatccagcaggttgtgcggggagatagcgccgcctactttgtgccagctctcccgat gagagccgggactctaatcagcctcagcactttggcgacgtgcaccaggctgtctattctcGA GGACCTGCGCAATGTGACCCCCCTAAGGTGTCCCTGTTTGAGCCCTCTAAGGCCGAGATCG CCAACAAGCAGAAGGCCACCCTGGTGTGCCTGGCCAGAGGCTTCTTCCCTGATCACGTGGAG CTGAGCTGGTGGGTGAATGGCAAGGAGGTGCACTCCGGCGTGTGCACCGACCCACAGGCCTA CAAGGAGTCCAACTACTCTTATTGTCTGTCCTCTAGGCTGCGCGTGAGCGCCACATTCTGGC ACAACCCTCGGAATCACTTCAGATGCCAGGTCAGTTTCACGGCCTGAGCGAGGAGGATAAG TGGCCAGAGGGCTCCCCAAAGCCCGTGACCCAGAATATCTCTGCCGAGGCATGGGCAGGGC CGACTGTGGAATCACCTCCGCCTCTTATCAGCAGGGCGTGCTGTCCGCCACAATCCTGTACG AGATCCTGCTGGGCAAGGCCACCCTGTATGCCGTGCTGGTGTCCACACTGGTGGTCATGGCC ATGGTGAAGCGCAAGAACAGCtaaggctccggagcaaccaatttcagcctgctgaagcaggc cggcgatgtggaggagaatcctggcccaATGGCTCAAGAGCTGGGCATGCAGTGTCAGGCCA GAGGAATCCTGCAGCAGATGTGGGGAGTGTTCCTGCTGTACGTGTCCATGAAGATGGGCGGC ACCACCGGCCAGAACATCGATCAGCCTACAGAGATGACCGCCACCGAGGGCGCCATCGTGCA GATCAATTGCACCTACCAGACCAGCGGCTTCAACGGCCTGTTCTGGTATCAGCAGCATGCCG GCGAGGCCCCTACCTTCCTGAGCTACAATGTGCTGGACGGCCTGGAAGAGAAGGGCAGATTC | TCR 56 Codon-optimized full sequence with mouse constant (nt) |

SEQUENCE TABLE

| SEQ ID NO | SEQUENCE | Description |
|---|---|---|
|  | AGCAGCTTCCTGTCCAGAAGCAAGGGCTACAGCTACCTGCTGCTGAAAGAACTGCAGATGAA<br>GGACAGCGCCTCCTACCTGTGCGCCGTTAGAGATTGGGGATACGGCGGAGCCACCAACAAGC<br>TGATCTTTGGCACAGGCACACTGCTGGCCGTGCAGCCTaatatccagaatccggagcctgcc<br>gtgtaccagctgaaggacccacggagccaggatagcaccctgtgcctgttcaccgactttga<br>ttctcagatcaacgtgcccaagaccatggagagcggcaccttcatcacagacaagtgcgtgc<br>tggatatgaaggccatggacagcaagtccaacggcgccatcgcctggtccaatcagacatct<br>ttcacctgccaggatatcttttaaggagacaaatgccacctatccttcctctgacgtgccatg<br>tgatgccaccctgacagagaagagcttcgagaccgacatgaacctgaattttcagaatctgc<br>tcgtgattgtcctgagaatcctgctgctgaaggtggccggctttaacctgctgatgaccctg<br>aggctgtggagctcctga |  |
| 423 | ATGGGCTGCAGGCTCCTCTGCTGTGTGGTCTTCTGCCTCCTCCAAGCAGGTCCCTTGGACAC<br>AGCTGTTTCCCAGACTCCAAAATACCTGGTCACACAGATGGGAAACGACAAGTCCATTAAAT<br>GTGAACAAAATCTGGGCCATGATACTATGTATTGGTATAAACAGGACTCTAAGAAATTTCTG<br>AAGATAATGTTTAGCTACAATAATAAGGAGCTCATTATAAATGAAACAGTTCCAAATCGCTT<br>CTCACCTAAATCTCCAGACAAAGCTCACTTAAATCTTCACATCAATTCCCTGGAGCTTGGTG<br>ACTCTGCTGTGTATTTCTGTGCCAGCAGCCAGGGGGAAGCTGGGGCCAACGTCCTGACTTTC<br>GGGGCCGGCAGCAGGCTGACCGTGCTGgaagatctgaagaacgtcttcccacctgaggtggc<br>cgtgttcgagccttctgaggccgagatcagccacacacagaaagccacactcgtgtgtctgg<br>ccaccggcttctatcccgatcacgtggaactgtcttggtgggtcaacggcaaagaggtgcac<br>agcggcgtctgtaccgatcctcagcctctgaaagagcagcccgctctgaacgacagcagata<br>ctgcctgagcagcagactgagagtgtccgccaccttctggcagaacccagaaaccacttca<br>gatgccaggtgcagttctacggcctgagcgagaacgatgagtggacccaggatagagccaag<br>cctgtgacacagatcgtgtctgccgaagcctggggcagagccgattgtggctttaccagcga<br>gagctaccagcagggcgtgctgtctgccacaatcctgtacgagatcctgctgggcaaagcca<br>ctctgtacgccgtgctggtgtctgccctggtgctgatggccatggtcaagcggaaggatagc<br>agaggc | TCR 64 Native full sequence with human constant (nt) |
| 424 | ATGGGAATCAGGCTCCTCTGTCGTGTGGCCTTTTGTTTCCTGGCTGTAGGCCTCGTAGATGT<br>GAAAGTAACCCAGAGCTCGAGATATCTAGTCAAAAGGACGGGAGAGAAAGTTTTTCTGGAAT<br>GTGTCCAGGATATGGACCATGAAAATATGTTCTGGTATCGACAAGACCCAGGTCTGGGGCTA<br>CGGCTGATCTATTTCTCATATGATGTTAAAATGAAAGAAAAAGGAGATATTCCTGAGGGGTA<br>CAGTGTCTCTAGAGAGAAGAAGGAGCGCTTCTCCCTGATTCTGGAGTCCGCCAGCACCAACC<br>AGACATCTATGTACCTCTGTGCCAGCAGTTTATGGGGACGGCGAAACACCGGGGAGCTGTTT<br>TTTGGAGAAGGCTCTAGGCTGACCGTACTGgaagatctgaagaacgtcttcccacctgaggt<br>ggccgtgttcgagccttctgaggccgagatcagccacacacagaaagccacactcgtgtgtc<br>tggccaccggcttctatcccgatcacgtggaactgtcttggtgggtcaacggcaaagaggtg<br>cacagcggcgtctgtaccgatcctcagcctctgaaagagcagcccgctctgaacgacagcag<br>atactgcctgagcagcagactgagagtgtccgccaccttctggcagaacccagaaaccact<br>tcagatgccaggtgcagttctacggcctgagcgagaacgatgagtggacccaggatagagcc<br>aagcctgtgacacagatcgtgtctgccgaagcctggggcagagccgattgtggctttaccag<br>cgagagctaccagcagggcgtgctgtctgccacaatcctgtacgagatcctgctgggcaaag<br>ccactctgtacgccgtgctggtgtctgccctggtgctgatggccatggtcaagcggaaggat<br>agcagaggc | TCR 65 Native full sequence with human constant (nt) |

SEQUENCE LISTING (424 sequences)

SEQ ID NO: 1 - DNA, 870 bp, Artificial Sequence
  TCR 56 Alpha Native with Codon Optimized Human Constant
atggctcaggaactgggaatgcagtgccaggctcgtggtatcctgcagcagatgtggggagttttccttctttatgtttccatgaagatgggaggcactacaggacaaaacattgaccagcccactgagatgacagctacggaaggtgccattgtccagatcaactgcacgtaccagacatctgggttcaacgggctgttctggtaccagcaacatgctggcgaagcacccacatttctgtcttacaatgttctggatggtttggaggagaaaggtcgtttttcttcattccttagtcggtctaaagggtacagttacctccttttgaaggagctccagatgaaagactctgcctcttacctctgtgctgtgagagattggggatatggtggtgctacaaacaagctcatctttggaactggcactctgcttgctgtccagccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 2 - DNA, 858 bp, Artificial Sequence
  TCR 56 Alpha Native with Codon Optimized Mouse Constant
atggctcaggaactgggaatgcagtgccaggctcgtggtatcctgcagcagatgtggggagttttccttctttatgtttccatgaagatgggaggcactacaggacaaaacattgaccagcccactgagatgacagctacggaaggtgccattgtccagatcaactgcacgtaccagacatctgggttcaacgggctgttctggtaccagcaacatgctggcgaagcacccacatttctgtcttacaatgttctggatggtttggaggagaaaggtcgtttttcttcattccttagtcggtctaaagggtacagttacctccttttgaaggagctccagatgaaagactctgcctcttacctctgtgctgtgagagattggggatatggtggtgctacaaacaagctcatctttggaactggcactctgcttgctgtccagccaaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 3 - DNA, 907 bp, Artificial Sequence
  TCR 56 Alpha Codon-Optimized with Codon Optimized Human Constant
atggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgcgccgttagagattggggatacggcggagccaccaacaagctgatctttggcacaggcacactgctggccgtgcagcctaatatccagaatccggagcctgccgtgtaccagctgaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 4 - DNA, 895 bp, Artificial Sequence
  TCR 56 Alpha Codon-Optimized with Codon Optimized Mouse Constant
atggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgcgccgttagagattggggatacggcggagccaccaacaagctgatctttggcacaggcacactgctggccgtgcagcctaatatccagaatccggagcctgccgtgtaccagctgaaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 5 - protein, 255 aa, Artificial Sequence
  TCR 56 Alpha with Codon Optimized Human Constant
GQNIDQPTEMTATEGAIVQINCTYQTSGFNGLFWYQQHAGEAPTFLSYNVLDGLEEKGRFSSFLSRSKGYSYLLLKELQMKDSASYLCAVRDWGYGGATNKLIFGTGTLLAVQPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 6 - protein, 251 aa, Artificial Sequence
  TCR 56 Alpha with Codon Optimized Mouse Constant
GQNIDQPTEMTATEGAIVQINCTYQTSGFNGLFWYQQHAGEAPTFLSYNVLDGLEEKGRFSSFLSRSKGYSYLLLKELQMKDSASYLCAVRDWGYGGATNKLIFGTGTLLAVQPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 7 - protein, 289 aa, Artificial Sequence
  TCR 56 Alpha with Codon Optimized Human Constant and signal peptide
MAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRDWGYGGATNKLIFGTGTLLAVQPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 8 - protein, 285 aa, Artificial Sequence
  TCR 56 Alpha with Codon Optimized Mouse Constant and signal peptide
MAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRDWGYGGATNKLIFGTGTLLAVQPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 9 - protein, 114 aa, Artificial Sequence
  TCR 56 Alpha variable region
GQNIDQPTEMTATEGAIVQINCTYQTSGFNGLFWYQQHAGEAPTFLSYNVLDGLEEKGRFSSFLSRSKGYSYLLLKELQMKDSASYLCAVRDWGYGGATNKLIFGTGTLLAVQP

SEQ ID NO: 10 - protein, 6 aa, Artificial Sequence
  TCR 56 Alpha CDR1
TSGFNG

SEQ ID NO: 11 - protein, 6 aa, Artificial Sequence
  TCR 56 Alpha CDR2
NVLDGL

SEQ ID NO: 12 - protein, 15 aa, Artificial Sequence
  TCR 56 Alpha CDR3
AVRDWGYGGATNKLI

SEQ ID NO: 13 - protein, 34 aa, Artificial Sequence
  TCR 56 Alpha Signal peptide
MAQELGMQCQARGILQQMWGVFLLYVSMKMGGTT

SEQ ID NO: 14 - protein, 141 aa, Homo sapiens
  Alpha Human constant region
NIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 15 - protein, 137 aa, Mus musculus
  Alpha Mouse constant region
NIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 16 - DNA, 957 bp, Artificial Sequence
  TCR 56 Beta Native with Codon Optimized Human Constant
atggccaactctgctatggacaccagagtactctgctgtgcggtcatctgtcttctgggggcaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccagacgaaagcagggatagcaatcagccccagcattttggtgatgggactcgactctccatcctagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa

SEQ ID NO: 17 - DNA, 945 bp, Artificial Sequence
  TCR 56 Beta Native with Codon Optimized Mouse Constant
atggccaactctgctatggacaccagagtactctgctgtgcggtcatctgtcttctgggggcaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccagacgaaagcagggatagcaatcagccccagcattttggtgatgggactcgactctccatcctagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaa

SEQ ID NO: 18 - DNA, 966 bp, Artificial Sequence
  TCR 56 Beta Codon-Optimized with Codon Optimized Human Constant
atgggacccatggccaatagcgccatggataccagagtgctgtgctgcgccgtgatctgtctgcttggagccggactgtctaatgccggcgtgatgcagaaccccagacacctcgttcggagaagaggccaagaggccagactgagatgcagccctatgaagggccacagccacgtgtactggtacagacagctgcctgaagagggcctgaagttcatggtgtacctgcagaaagagaacatcatcgacgagagcggcatgcccaaagagcggttctctgccgagtttcccaaagagggccccagcatcctgagaatccagcaggttgtgcggggagatagcgccgcctacttttgtgccagctctcccgatgagagccgggactctaatcagcctcagcactttggcgacggcaccaggctgtctattctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa

SEQ ID NO: 19 - DNA, 954 bp, Artificial Sequence
  TCR 56 Beta Codon-Optimized with Codon Optimized Mouse Constant
atgggacccatggccaatagcgccatggataccagagtgctgtgctgcgccgtgatctgtctgcttggagccggactgtctaatgccggcgtgatgcagaaccccagacacctcgttcggagaagaggccaagaggccagactgagatgcagccctatgaagggccacagccacgtgtactggtacagacagctgcctgaagagggcctgaagttcatggtgtacctgcagaaagagaacatcatcgacgagagcggcatgcccaaagagcggttctctgccgagtttcccaaagagggccccagcatcctgagaatccagcaggttgtgcggggagatagcgccgcctacttttgtgccagctctcccgatgagagccgggactctaatcagcctcagcactttggcgacggcaccaggctgtctattctcgaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaa

SEQ ID NO: 20 - protein, 294 aa, Artificial Sequence
  TCR 56 Beta with Codon Optimized Human Constant
NAGVMQNPRHLVRRRGQEARLRCSPMKGHSHVYWYRQLPEEGLKFMVYLQKENIIDESGMPKERFSAEFPKEGPSILRIQQVVRGDSAAYFCASSPDESRDSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 21 - protein, 290 aa, Artificial Sequence
  TCR 56 Beta with Codon Optimized Mouse Constant
NAGVMQNPRHLVRRRGQEARLRCSPMKGHSHVYWYRQLPEEGLKFMVYLQKENIIDESGMPKERFSAEFPKEGPSILRIQQVVRGDSAAYFCASSPDESRDSNQPQHFGDGTRLSILEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 22 - protein, 318 aa, Artificial Sequence
  TCR 56 Beta with Codon Optimized Human Constant and signal peptide
MANSAMDTRVLCCAVICLLGAGLSNAGVMQNPRHLVRRRGQEARLRCSPMKGHSHVYWYRQLPEEGLKFMVYLQKENIIDESGMPKERFSAEFPKEGPSILRIQQVVRGDSAAYFCASSPDESRDSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 23 - protein, 314 aa, Artificial Sequence
  TCR 56 Beta with Codon Optimized Mouse Constant and signal peptide
MANSAMDTRVLCCAVICLLGAGLSNAGVMQNPRHLVRRRGQEARLRCSPMKGHSHVYWYRQLPEEGLKFMVYLQKENIIDESGMPKERFSAEFPKEGPSILRIQQVVRGDSAAYFCASSPDESRDSNQPQHFGDGTRLSILEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 24 - protein, 117 aa, Artificial Sequence
  TCR 56 Beta variable region
NAGVMQNPRHLVRRRGQEARLRCSPMKGHSHVYWYRQLPEEGLKFMVYLQKENIIDESGMPKERFSAEFPKEGPSILRIQQVVRGDSAAYFCASSPDESRDSNQPQHFGDGTRLSIL

SEQ ID NO: 25 - protein, 5 aa, Artificial Sequence
  TCR 56 Beta CDR1
KGHSH

SEQ ID NO: 26 - protein, 6 aa, Artificial Sequence
  TCR 56 Beta CDR2
LQKENI

SEQ ID NO: 27 - protein, 15 aa, Artificial Sequence
  TCR 56 Beta CDR3
ASSPDESRDSNQPQH

SEQ ID NO: 28 - protein, 24 aa, Artificial Sequence
  TCR 56 Beta signal peptide
MANSAMDTRVLCCAVICLLGAGLS

SEQ ID NO: 29 - protein, 177 aa, Homo sapiens
  Beta human constant region
EDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 30 - protein, 173 aa, Mus musculus
  Beta mouse constant region
EDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 31 - DNA, 66 bp, Artificial Sequence
  P2A
ggctccggagcaaccaatttcagcctgctgaagcaggccggcgatgtggaggagaatcctggccca

SEQ ID NO: 32 - protein, 22 aa, Artificial Sequence
  P2A
GSGATNFSLLKQAGDVEENPGP

SEQ ID NO: 33 - DNA, 1026 bp, Artificial Sequence
  TCR 56 Native full sequence with human constant
gaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 34 - DNA, 1869 bp, Artificial Sequence
  TCR 56 Nativefull sequence with mouse constant
atggccaactctgctatggacaccagagtactctgctgtgcggtcatctgtcttctgggggcaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccagacgaaagcagggatagcaatcagccccagcattttggtgatgggactcgactctccatcctagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatggctcaggaactgggaatgcagtgccaggctcgtggtatcctgcagcagatgtggggagttttccttctttatgtttccatgaagatgggaggcactacaggacaaaacattgaccagcccactgagatgacagctacggaaggtgccattgtccagatcaactgcacgtaccagacatctgggttcaacgggctgttctggtaccagcaacatgctggcgaagcacccacatttctgtcttacaatgttctggatggtttggaggagaaaggtcgtttttcttcattccttagtcggtctaaagggtacagttacctccttttgaaggagctccagatgaaagactctgcctcttacctctgtgctgtgagagattggggatatggtggtgctacaaacaagctcatctttggaactggcactctgcttgctgtccagccaaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 35 - DNA, 1939 bp, Artificial Sequence
  TCR 56 Codon-optimized full sequence with human constant
atgggacccatggccaatagcgccatggataccagagtgctgtgctgcgccgtgatctgtctgcttggagccggactgtctaatgccggcgtgatgcagaaccccagacacctcgttcggagaagaggccaagaggccagactgagatgcagccctatgaagggccacagccacgtgtactggtacagacagctgcctgaagagggcctgaagttcatggtgtacctgcagaaagagaacatcatcgacgagagcggcatgcccaaagagcggttctctgccgagtttcccaaagagggccccagcatcctgagaatccagcaggttgtgcggggagatagcgccgcctacttttgtgccagctctcccgatgagagccgggactctaatcagcctcagcactttggcgacggcaccaggctgtctattctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgcgccgttagagattggggatacggcggagccaccaacaagctgatctttggcacaggcacactgctggccgtgcagcctaatatccagaatccggagcctgccgtgtaccagctgaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 36 - DNA, 1915 bp, Artificial Sequence
  TCR 56 Codon-optimized full sequence with mouse constant
atgggacccatggccaatagcgccatggataccagagtgctgtgctgcgccgtgatctgtctgcttggagccggactgtctaatgccggcgtgatgcagaaccccagacacctcgttcggagaagaggccaagaggccagactgagatgcagccctatgaagggccacagccacgtgtactggtacagacagctgcctgaagagggcctgaagttcatggtgtacctgcagaaagagaacatcatcgacgagagcggcatgcccaaagagcggttctctgccgagtttcccaaagagggccccagcatcctgagaatccagcaggttgtgcggggagatagcgccgcctacttttgtgccagctctcccgatgagagccgggactctaatcagcctcagcactttggcgacggcaccaggctgtctattctcgaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgcgccgttagagattggggatacggcggagccaccaacaagctgatctttggcacaggcacactgctggccgtgcagcctaatatccagaatccggagcctgccgtgtaccagctgaaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 37 - protein, 629 aa, Artificial Sequence
  TCR 56 Full sequence with human constant
MANSAMDTRVLCCAVICLLGAGLSNAGVMQNPRHLVRRRGQEARLRCSPMKGHSHVYWYRQLPEEGLKFMVYLQKENIIDESGMPKERFSAEFPKEGPSILRIQQVVRGDSAAYFCASSPDESRDSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRDWGYGGATNKLIFGTGTLLAVQPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 38 - protein, 621 aa, Artificial Sequence
  TCR 56 Full sequence with mouse constant
MANSAMDTRVLCCAVICLLGAGLSNAGVMQNPRHLVRRRGQEARLRCSPMKGHSHVYWYRQLPEEGLKFMVYLQKENIIDESGMPKERFSAEFPKEGPSILRIQQVVRGDSAAYFCASSPDESRDSNQPQHFGDGTRLSILEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSGSGATNFSLLKQAGDVEENPGPMAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRDWGYGGATNKLIFGTGTLLAVQPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 39 - DNA, 810 bp, Artificial Sequence
  TCR 57 Alpha Native with Codon Optimized Human Constant
atggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcaggagctcgcaacttcaacaaattttactttggatctgggaccaaactcaatgtaaaaccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 40 - DNA, 798 bp, Artificial Sequence
  TCR 57 Alpha Native with Codon Optimized Mouse Constant
atggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcaggagctcgcaacttcaacaaattttactttggatctgggaccaaactcaatgtaaaaccaaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 41 - DNA, 810 bp, Artificial Sequence
  TCR 57 Alpha Codon-Optimized with Codon Optimized Human Constant
atggtgctgaagttttctgtgagcatcctgtggattcagctggcctgggtgtccacccagctcctggagcagagcccccagttcctgtccatccaggagggcgagaacctgaccgtgtactgcaacagctcttctgtcttttcatcactgcagtggtatagacaagaaccgggtgaaggtccagttctgctggtgaccgtcgtcaccggcggcgaggtgaagaagctaaagcgcctgacgttccagttcggagacgcgcggaaggactcgtcgctgcacatcaccgccgcccagcccggcgacaccggcctgtacctgtgcgctggcgcgcgcaacttcaacaagttctacttcggcagcggcaccaagctgaacgtgaaaccgaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 42 - DNA, 798 bp, Artificial Sequence
  TCR 57 Alpha Codon-Optimized with Codon Optimized Mouse Constant
atggtgctgaagttttctgtgagcatcctgtggattcagctggcctgggtgtccacccagctcctggagcagagcccccagttcctgtccatccaggagggcgagaacctgaccgtgtactgcaacagctcttctgtcttttcatcactgcagtggtatagacaagaaccgggtgaaggtccagttctgctggtgaccgtcgtcaccggcggcgaggtgaagaagctaaagcgcctgacgttccagttcggagacgcgcggaaggactcgtcgctgcacatcaccgccgcccagcccggcgacaccggcctgtacctgtgcgctggcgcgcgcaacttcaacaagttctacttcggcagcggcaccaagctgaacgtgaaaccgaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 43 - protein, 251 aa, Artificial Sequence
  TCR 57 Alpha with Codon Optimized Human Constant
TQLLEQSPQFLSIQEGENLTVYCNSSSVFSSLQWYRQEPGEGPVLLVTVVTGGEVKKLKRLTFQFGDARKDSSLHITAAQPGDTGLYLCAGARNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 44 - protein, 247 aa, Artificial Sequence
  TCR 57 Alpha with Codon Optimized Mouse Constant
TQLLEQSPQFLSIQEGENLTVYCNSSSVFSSLQWYRQEPGEGPVLLVTVVTGGEVKKLKRLTFQFGDARKDSSLHITAAQPGDTGLYLCAGARNFNKFYFGSGTKLNVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 45 - protein, 269 aa, Artificial Sequence
  TCR 57 Alpha with Codon Optimized Human Constant and signal peptide
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 46 - protein, 265 aa, Artificial Sequence
  TCR 57 Alpha with Codon Optimized Mouse Constant and signal peptide
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARNFNKFYFGSGTKLNVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 47 - protein, 110 aa, Artificial Sequence
  TCR 57 Alpha variable region
TQLLEQSPQFLSIQEGENLTVYCNSSSVFSSLQWYRQEPGEGPVLLVTVVTGGEVKKLKRLTFQFGDARKDSSLHITAAQPGDTGLYLCAGARNFNKFYFGSGTKLNVKP

SEQ ID NO: 48 - protein, 5 aa, Artificial Sequence
  TCR 57 Alpha CDR1
SVFSS

SEQ ID NO: 49 - protein, 7 aa, Artificial Sequence
  TCR 57 Alpha CDR2
VVTGGEV

SEQ ID NO: 50 - protein, 10 aa, Artificial Sequence
  TCR 57 Alpha CDR3
AGARNFNKFY

SEQ ID NO: 51 - protein, 18 aa, Artificial Sequence
  TCR 57 Alpha Signal peptide
MVLKFSVSILWIQLAWVS

SEQ ID NO: 52 - DNA, 924 bp, Artificial Sequence
  TCR 57 Beta Native with Codon Optimized Human Constant
atgctgctgcttctgctgcttctggggccaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagatcttggcgggggggccttgagcagttcttcgggccagggacacggctcaccgtgctagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa

SEQ ID NO: 53 - DNA, 912 bp, Artificial Sequence
  TCR 57 Beta Native with Codon Optimized Mouse Constant
atgctgctgcttctgctgcttctggggccaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagatcttggcgggggggccttgagcagttcttcgggccagggacacggctcaccgtgctagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaa

SEQ ID NO: 54 - DNA, 924 bp, Artificial Sequence
  TCR 57 Beta Codon-Optimized with Codon Optimized Human Constant
atgctcctgctgcttctgctcctcgggcccggcagcggtctcggcgccgtcgtgtcgcagcacccgtcgtgggtgatttgcaagagcggaacgagcgtgaagatcgagtgccgctcgctcgacttccaggccacaaccatgttctggtaccgccagtttcccaagcagagcctcatgctgatggccacaagcaatgaaggcagcaaggccacttatgaacagggcgtggagaaggacaagtttctgatcaaccacgcctccctgaccctgtccaccctcactgtgaccagcgcccaccctgaggacagcagcttctacatctgcagcgcccgcagctggaggggcggcctggagcagttcttcggccctggcacccggctgacagtgctggaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa

SEQ ID NO: 55 - DNA, 912 bp, Artificial Sequence
  TCR 57 Beta Codon-Optimized with Codon Optimized Mouse Constant
atgctcctgctgcttctgctcctcgggcccggcagcggtctcggcgccgtcgtgtcgcagcacccgtcgtgggtgatttgcaagagcggaacgagcgtgaagatcgagtgccgctcgctcgacttccaggccacaaccatgttctggtaccgccagtttcccaagcagagcctcatgctgatggccacaagcaatgaaggcagcaaggccacttatgaacagggcgtggagaaggacaagtttctgatcaaccacgcctccctgaccctgtccaccctcactgtgaccagcgcccaccctgaggacagcagcttctacatctgcagcgcccgcagctggaggggcggcctggagcagttcttcggccctggcacccggctgacagtgctggaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaa

SEQ ID NO: 56 - protein, 293 aa, Artificial Sequence
  TCR 57 Beta with Codon Optimized Human Constant
GAVVSQHPSWVICKSGTSVKIECRSLDFQATTMFWYRQFPKQSLMLMATSNEGSKATYEQGVEKDKFLINHASLTLSTLTVTSAHPEDSSFYICSARSWRGGLEQFFGPGTRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 57 - protein, 289 aa, Artificial Sequence
  TCR 57 Beta with Codon Optimized Mouse Constant
GAVVSQHPSWVICKSGTSVKIECRSLDFQATTMFWYRQFPKQSLMLMATSNEGSKATYEQGVEKDKFLINHASLTLSTLTVTSAHPEDSSFYICSARSWRGGLEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 58 - protein, 307 aa, Artificial Sequence
  TCR 57 Beta with Codon Optimized Human Constant and signal peptide
MLLLLLLLGPGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSARSWRGGLEQFFGPGTRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 59 - protein, 303 aa, Artificial Sequence
  TCR 57 Beta with Codon Optimized Mouse Constant and signal peptide
MLLLLLLLGPGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSARSWRGGLEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 60 - protein, 116 aa, Artificial Sequence
  TCR 57 Beta variable region
GAVVSQHPSWVICKSGTSVKIECRSLDFQATTMFWYRQFPKQSLMLMATSNEGSKATYEQGVEKDKFLINHASLTLSTLTVTSAHPEDSSFYICSARSWRGGLEQFFGPGTRLTVL

SEQ ID NO: 61 - protein, 6 aa, Artificial Sequence
  TCR 57 Beta CDR1
DFQATT

SEQ ID NO: 62 - protein, 7 aa, Artificial Sequence
  TCR 57 Beta CDR2
SNEGSKA

SEQ ID NO: 63 - protein, 12 aa, Artificial Sequence
  TCR 57 Beta CDR3
SARSWRGGLEQF

SEQ ID NO: 64 - protein, 14 aa, Artificial Sequence
  TCR 57 Beta signal peptide
MLLLLLLLGPGSGL

SEQ ID NO: 65 - DNA, 1800 bp, Artificial Sequence
  TCR 57 Native full sequence with human constant
atgctgctgcttctgctgcttctggggccaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagatcttggcgggggggccttgagcagttcttcgggccagggacacggctcaccgtgctagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcaggagctcgcaacttcaacaaattttactttggatctgggaccaaactcaatgtaaaaccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 66 - DNA, 1776 bp, Artificial Sequence
  TCR 57 Nativefull sequence with mouse constant
atgctgctgcttctgctgcttctggggccaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagatcttggcgggggggccttgagcagttcttcgggccagggacacggctcaccgtgctagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcaggagctcgcaacttcaacaaattttactttggatctgggaccaaactcaatgtaaaaccaaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 67 - DNA, 1800 bp, Artificial Sequence
  TCR 57 Codon-optimized full sequence with human constant
atgctcctgctgcttctgctcctcgggcccggcagcggtctcggcgccgtcgtgtcgcagcacccgtcgtgggtgatttgcaagagcggaacgagcgtgaagatcgagtgccgctcgctcgacttccaggccacaaccatgttctggtaccgccagtttcccaagcagagcctcatgctgatggccacaagcaatgaaggcagcaaggccacttatgaacagggcgtggagaaggacaagtttctgatcaaccacgcctccctgaccctgtccaccctcactgtgaccagcgcccaccctgaggacagcagcttctacatctgcagcgcccgcagctggaggggcggcctggagcagttcttcggccctggcacccggctgacagtgctggaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatggtgctgaagttttctgtgagcatcctgtggattcagctggcctgggtgtccacccagctcctggagcagagcccccagttcctgtccatccaggagggcgagaacctgaccgtgtactgcaacagctcttctgtcttttcatcactgcagtggtatagacaagaaccgggtgaaggtccagttctgctggtgaccgtcgtcaccggcggcgaggtgaagaagctaaagcgcctgacgttccagttcggagacgcgcggaaggactcgtcgctgcacatcaccgccgcccagcccggcgacaccggcctgtacctgtgcgctggcgcgcgcaacttcaacaagttctacttcggcagcggcaccaagctgaacgtgaaaccgaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 68 - DNA, 1776 bp, Artificial Sequence
  TCR 57 Codon-optimized full sequence with mouse constant
atgctcctgctgcttctgctcctcgggcccggcagcggtctcggcgccgtcgtgtcgcagcacccgtcgtgggtgatttgcaagagcggaacgagcgtgaagatcgagtgccgctcgctcgacttccaggccacaaccatgttctggtaccgccagtttcccaagcagagcctcatgctgatggccacaagcaatgaaggcagcaaggccacttatgaacagggcgtggagaaggacaagtttctgatcaaccacgcctccctgaccctgtccaccctcactgtgaccagcgcccaccctgaggacagcagcttctacatctgcagcgcccgcagctggaggggcggcctggagcagttcttcggccctggcacccggctgacagtgctggaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatggtgctgaagttttctgtgagcatcctgtggattcagctggcctgggtgtccacccagctcctggagcagagcccccagttcctgtccatccaggagggcgagaacctgaccgtgtactgcaacagctcttctgtcttttcatcactgcagtggtatagacaagaaccgggtgaaggtccagttctgctggtgaccgtcgtcaccggcggcgaggtgaagaagctaaagcgcctgacgttccagttcggagacgcgcggaaggactcgtcgctgcacatcaccgccgcccagcccggcgacaccggcctgtacctgtgcgctggcgcgcgcaacttcaacaagttctacttcggcagcggcaccaagctgaacgtgaaaccgaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 69 - protein, 598 aa, Artificial Sequence
  TCR 57 Full sequence with human constant
MLLLLLLLGPGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSARSWRGGLEQFFGPGTRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 70 - protein, 590 aa, Artificial Sequence
  TCR 57 Full sequence with mouse constant
MLLLLLLLGPGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSARSWRGGLEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSGSGATNFSLLKQAGDVEENPGPMVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARNFNKFYFGSGTKLNVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 71 - DNA, 825 bp, Artificial Sequence
  TCR 58 Alpha Native with Codon Optimized Human Constant
atgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacagggataactatggtcagaattttgtctttggtcccggaaccagattgtccgtgctgcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 72 - protein, 812 aa, Artificial Sequence
  TCR 58 Alpha Native with Codon Optimized Mouse Constant
ATGATGATATCCTTGAGAGTTTTACTGGTGATCCTGTGGCTTCAGTTAAGCTGGGTTTGGAGCCAACGGAAGGAGGTGGAGCAGGATCCTGGACCCTTCAATGTTCCAGAGGGAGCCACTGTCGCTTTCAACTGTACTTACAGCAACAGTGCTTCTCAGTCTTTCTTCTGGTACAGACAGGATTGCAGGAAAGAACCTAAGTTGCTGATGTCGTATACTCCAGTGGTAATGAAGATGGAAGGTTTACAGCACAGCTCAATAGAGCCAGCCAGTATATTTCCCTGCTCATCAGAGACTCCAAGCTCAGTGATTCAGCCACCTACCTCTGTGTGGTGAACAGGGATAACTATGGTCAGAATTTTGTCTTTGGTCCCGGAACCAGATTGTCCGTGCTGCCCAATATCCAGAATCCGGAGCCTGCCGTGTACCAGCTGAAGGACCCACGGAGCCAGGATAGCACCCTGTGCCTGTTCACCGACTTTGATTCTCAGATCAACGTGCCCAAGACCATGGAGAGCGGCACCTTCATCACAGACAAGTGCGTGCTGGATATGAAGGCCATGGACAGCAAGTCCAACGGCGCCATCGCCTGGTCCAATCAGACATCTTTCACCTGCCAGGATATCTTTAAGGAGACAAATGCCACCTATCCTTCCTCTGACGTGCCATGTGATGCCACCCTGACAGAGAAGAGCTTCGAGACCGACATGAACCTGAATTTTCAGAATCTGCTCGTGATTGTCCTGAGAATCCTGCTGCTGAAGGTGGCCGGCTTTAACCTGCTGATGACCCTGAGGCTGTGGAGCTCCTGA

SEQ ID NO: 73 - protein, 252 aa, Artificial Sequence
  TCR 58 Alpha with Codon Optimized Human Constant
RKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 74 - protein, 248 aa, Artificial Sequence
  TCR 58 Alpha with Codon Optimized Mouse Constant
RKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 75 - protein, 274 aa, Artificial Sequence
  TCR 58 Alpha with Codon Optimized Human Constant and signal peptide
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 76 - protein, 270 aa, Artificial Sequence
  TCR 58 Alpha with Codon Optimized Mouse Constant and signal peptide
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 77 - protein, 111 aa, Artificial Sequence
  TCR 58 Alpha variable region
RKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLP

SEQ ID NO: 78 - protein, 6 aa, Artificial Sequence
  TCR 58 Alpha CDR1
NSASQS

SEQ ID NO: 79 - protein, 6 aa, Artificial Sequence
  TCR 58 Alpha CDR2
VYSSGN

SEQ ID NO: 80 - protein, 12 aa, Artificial Sequence
  TCR 58 Alpha CDR3
VVNRDNYGQNFV

SEQ ID NO: 81 - protein, 22 aa, Artificial Sequence
  TCR 58 Alpha Signal peptide
MMISLRVLLVILWLQLSWVWSQ

SEQ ID NO: 82 - DNA, 930 bp, Artificial Sequence
  TCR 58 Beta Native with Codon Optimized Human Constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccccccgaagctcctacgagcagtacttcgggccgggcaccaggctcacggtcacagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa

SEQ ID NO: 83 - DNA, 918 bp, Artificial Sequence
  TCR 58 Beta Native with Codon Optimized Mouse Constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccccccgaagctcctacgagcagtacttcgggccgggcaccaggctcacggtcacagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaa

SEQ ID NO: 84 - protein, 290 aa, Artificial Sequence
  TCR 58 Beta with Codon Optimized Human Constant
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRSSYEQYFGPGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 85 - protein, 286 aa, Artificial Sequence
  TCR 58 Beta with Codon Optimized Mouse Constant
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRSSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 86 - protein, 309 aa, Artificial Sequence
  TCR 58 Beta with Codon Optimized Human Constant and signal peptide
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRSSYEQYFGPGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 87 - protein, 305 aa, Artificial Sequence
  TCR 58 Beta with Codon Optimized Mouse Constant and signal peptide
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRSSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 88 - protein, 113 aa, Artificial Sequence
  TCR 58 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRSSYEQYFGPGTRLTVT

SEQ ID NO: 89 - protein, 5 aa, Artificial Sequence
  TCR 58, 59, 60, 61 Beta CDR1
SNHLY

SEQ ID NO: 90 - protein, 6 aa, Artificial Sequence
  TCR 58, 59, 60 61 Beta CDR2
FYNNEI

SEQ ID NO: 91 - protein, 11 aa, Artificial Sequence
  TCR 58 Beta CDR3
ASTPRSSYEQY

SEQ ID NO: 92 - protein, 19 aa, Artificial Sequence
  TCR 58, 59, 60, 61 Beta signal peptide
MDTWLVCWAIFSLLKAGLT

SEQ ID NO: 93 - DNA, 1821 bp, Artificial Sequence
  TCR 58 Native full sequence with human constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccccccgaagctcctacgagcagtacttcgggccgggcaccaggctcacggtcacagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacagggataactatggtcagaattttgtctttggtcccggaaccagattgtccgtgctgcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 94 - DNA, 1797 bp, Artificial Sequence
  TCR 58 Nativefull sequence with mouse constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccccccgaagctcctacgagcagtacttcgggccgggcaccaggctcacggtcacagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacagggataactatggtcagaattttgtctttggtcccggaaccagattgtccgtgctgcccaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 95 - protein, 605 aa, Artificial Sequence
  TCR 58 Full sequence with human constant
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRSSYEQYFGPGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 96 - protein, 597 aa, Artificial Sequence
  TCR 58 Full sequence with mouse constant
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRSSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 97 - DNA, 831 bp, Artificial Sequence
  TCR 59 Alpha Native with Codon Optimized Human Constant
atgaagagggagagggagatgctactcatcacatcaatgttggtcttatggatgcaattgtcacaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcacccaagcgggaatatggaaacaaactggtctttggcgcaggaaccattctgagagtcaagtccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 98 - DNA, 819 bp, Artificial Sequence
  TCR 59 Alpha Native with Codon Optimized Mouse Constant
atgaagagggagagggagatgctactcatcacatcaatgttggtcttatggatgcaattgtcacaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcacccaagcgggaatatggaaacaaactggtctttggcgcaggaaccattctgagagtcaagtccaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 99 - protein, 252 aa, Artificial Sequence
  TCR 59 Alpha with Codon Optimized Human Constant
GQQVMQIPQYQHVQEGEDFTTYCNSSTTLSNIQWYKQRPGGHPVFLIQLVKSGEVKKQKRLTFQFGEAKKNSSLHITATQTTDVGTYFCAPKREYGNKLVFGAGTILRVKSNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 100 - protein, 248 aa, Artificial Sequence
  TCR 59 Alpha with Codon Optimized Mouse Constant
GQQVMQIPQYQHVQEGEDFTTYCNSSTTLSNIQWYKQRPGGHPVFLIQLVKSGEVKKQKRLTFQFGEAKKNSSLHITATQTTDVGTYFCAPKREYGNKLVFGAGTILRVKSNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 101 - protein, 276 aa, Artificial Sequence
  TCR 59 Alpha with Codon Optimized Human Constant and signal peptide
MKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAPKREYGNKLVFGAGTILRVKSNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 102 - protein, 272 aa, Artificial Sequence
  TCR 59 Alpha with Codon Optimized Mouse Constant and signal peptide
MKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAPKREYGNKLVFGAGTILRVKSNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 103 - protein, 111 aa, Artificial Sequence
  TCR 59 Alpha variable region
GQQVMQIPQYQHVQEGEDFTTYCNSSTTLSNIQWYKQRPGGHPVFLIQLVKSGEVKKQKRLTFQFGEAKKNSSLHITATQTTDVGTYFCAPKREYGNKLVFGAGTILRVKS

SEQ ID NO: 104 - protein, 5 aa, Artificial Sequence
  TCR 59 Alpha CDR1
TTLSN

SEQ ID NO: 105 - protein, 7 aa, Artificial Sequence
  TCR 59 Alpha CDR2
LVKSGEV

SEQ ID NO: 106 - protein, 11 aa, Artificial Sequence
  TCR 59 Alpha CDR3
APKREYGNKLV

SEQ ID NO: 107 - protein, 24 aa, Artificial Sequence
  TCR 59 Alpha Signal peptide
MKREREMLLITSMLVLWMQLSQVN

SEQ ID NO: 108 - DNA, 930 bp, Artificial Sequence
  TCR 59 Beta Native with Codon Optimized Human Constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgcctattcgggcagggcctcctacgagcagtacttcgggccgggcaccaggctcacggtcacagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa

SEQ ID NO: 109 - DNA, 918 bp, Artificial Sequence
  TCR 59 Beta Native with Codon Optimized Mouse Constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgcctattcgggcagggcctcctacgagcagtacttcgggccgggcaccaggctcacggtcacagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaa

SEQ ID NO: 110 - protein, 290 aa, Artificial Sequence
  TCR 59 Beta with Codon Optimized Human Constant
EPEVTQTPSHQVTQMGQEVILRCVPISNHLYFYWYRQILGQKVEFLVSFYNNEISEKSEIFDDQFSVERPDGSNFTLKIRSTKLEDSAMYFCAYSGRASYEQYFGPGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 111 - protein, 286 aa, Artificial Sequence
  TCR 59 Beta with Codon Optimized Mouse Constant
EPEVTQTPSHQVTQMGQEVILRCVPISNHLYFYWYRQILGQKVEFLVSFYNNEISEKSEIFDDQFSVERPDGSNFTLKIRSTKLEDSAMYFCAYSGRASYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 112 - protein, 309 aa, Artificial Sequence
  TCR 59 Beta with Codon Optimized Human Constant and signal peptide
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAYSGRASYEQYFGPGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 113 - protein, 305 aa, Artificial Sequence
  TCR 59 Beta with Codon Optimized Mouse Constant and signal peptide
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAYSGRASYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 114 - protein, 113 aa, Artificial Sequence
  TCR 59 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAYSGRASYEQYFGPGTRLTVT

SEQ ID NO: 115 - protein, 11 aa, Artificial Sequence
  TCR 59 Beta CDR3
AYSGRASYEQY

SEQ ID NO: 116 - DNA, 1827 bp, Artificial Sequence
  TCR 59 Native full sequence with human constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgcctattcgggcagggcctcctacgagcagtacttcgggccgggcaccaggctcacggtcacagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatgaagagggagagggagatgctactcatcacatcaatgttggtcttatggatgcaattgtcacaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcacccaagcgggaatatggaaacaaactggtctttggcgcaggaaccattctgagagtcaagtccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 117 - DNA, 1803 bp, Artificial Sequence
  TCR 59 Nativefull sequence with mouse constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgcctattcgggcagggcctcctacgagcagtacttcgggccgggcaccaggctcacggtcacagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatgaagagggagagggagatgctactcatcacatcaatgttggtcttatggatgcaattgtcacaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcacccaagcgggaatatggaaacaaactggtctttggcgcaggaaccattctgagagtcaagtccaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 118 - protein, 607 aa, Artificial Sequence
  TCR 59 Full sequence with human constant
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAYSGRASYEQYFGPGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAPKREYGNKLVFGAGTILRVKSNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 119 - protein, 599 aa, Artificial Sequence
  TCR 59 Full sequence with mouse constant
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAYSGRASYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSGSGATNFSLLKQAGDVEENPGPMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAPKREYGNKLVFGAGTILRVKSNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 120 - DNA, 837 bp, Artificial Sequence
  TCR 60 Alpha Native with Codon Optimized Human Constant
atgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatgttggggagtggaggtagcaactataaactgacatttggaaaaggaactctcttaaccgtgaatccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 121 - DNA, 825 bp, Artificial Sequence
  TCR 60 Alpha Native with Codon Optimized Mouse Constant
atgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatgttggggagtggaggtagcaactataaactgacatttggaaaaggaactctcttaaccgtgaatccaaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 122 - protein, 256 aa, Artificial Sequence
  TCR 60 Alpha with Codon Optimized Human Constant
QKEVEQNSGPLSVPEGAIASLNCTYSDRGSQSFFWYRQYSGKSPELIMFIYSNGDKEDGRFTAQLNKASQYVSLLIRDSQPSDSATYLCAVNMLGSGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 123 - protein, 252 aa, Artificial Sequence
  TCR 60 Alpha with Codon Optimized Mouse Constant
QKEVEQNSGPLSVPEGAIASLNCTYSDRGSQSFFWYRQYSGKSPELIMFIYSNGDKEDGRFTAQLNKASQYVSLLIRDSQPSDSATYLCAVNMLGSGGSNYKLTFGKGTLLTVNPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 124 - protein, 278 aa, Artificial Sequence
  TCR 60 Alpha with Codon Optimized Human Constant and signal peptide
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNMLGSGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 125 - protein, 274 aa, Artificial Sequence
  TCR 60 Alpha with Codon Optimized Mouse Constant and signal peptide
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNMLGSGGSNYKLTFGKGTLLTVNPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 126 - protein, 115 aa, Artificial Sequence
  TCR 60 Alpha variable region
QKEVEQNSGPLSVPEGAIASLNCTYSDRGSQSFFWYRQYSGKSPELIMFIYSNGDKEDGRFTAQLNKASQYVSLLIRDSQPSDSATYLCAVNMLGSGGSNYKLTFGKGTLLTVNP

SEQ ID NO: 127 - protein, 6 aa, Artificial Sequence
  TCR 60, 61 Alpha CDR1
DRGSQS

SEQ ID NO: 128 - protein, 6 aa, Artificial Sequence
  TCR 60, 61 Alpha CDR2
IYSNGD

SEQ ID NO: 129 - protein, 15 aa, Artificial Sequence
  TCR 60 Alpha CDR3
AVNMLGSGGSNYKLT

SEQ ID NO: 130 - protein, 22 aa, Artificial Sequence
  TCR 60, 61 Alpha Signal peptide
MMKSLRVLLVILWLQLSWVWSQ

SEQ ID NO: 131 - DNA, 930 bp, Artificial Sequence
  TCR 60 Beta Native with Codon Optimized Human Constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatcagtcggacagtctcctacgagcagtacttcgggccgggcaccaggctcacggtcacagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa

SEQ ID NO: 132 - DNA, 918 bp, Artificial Sequence
  TCR 60 Beta Native with Codon Optimized Mouse Constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatcagtcggacagtctcctacgagcagtacttcgggccgggcaccaggctcacggtcacagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaa

SEQ ID NO: 133 - protein, 290 aa, Artificial Sequence
  TCR 60 Beta with Codon Optimized Human Constant
EPEVTQTPSHQVTQMGQEVILRCVPISNHLYFYWYRQILGQKVEFLVSFYNNEISEKSEIFDDQFSVERPDGSNFTLKIRSTKLEDSAMYFCAISRTVSYEQYFGPGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 134 - protein, 286 aa, Artificial Sequence
  TCR 60 Beta with Codon Optimized Mouse Constant
EPEVTQTPSHQVTQMGQEVILRCVPISNHLYFYWYRQILGQKVEFLVSFYNNEISEKSEIFDDQFSVERPDGSNFTLKIRSTKLEDSAMYFCAISRTVSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 135 - protein, 309 aa, Artificial Sequence
  TCR 60 Beta with Codon Optimized Human Constant and signal peptide
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAISRTVSYEQYFGPGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 136 - protein, 305 aa, Artificial Sequence
  TCR 60 Beta with Codon Optimized Mouse Constant and signal peptide
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAISRTVSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 137 - protein, 113 aa, Artificial Sequence
  TCR 60 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAISRTVSYEQYFGPGTRLTVT

SEQ ID NO: 138 - protein, 11 aa, Artificial Sequence
  TCR 60 Beta CDR3
AISRTVSYEQY

SEQ ID NO: 139 - DNA, 1833 bp, Artificial Sequence
  TCR 60 Native full sequence with human constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatcagtcggacagtctcctacgagcagtacttcgggccgggcaccaggctcacggtcacagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatgttggggagtggaggtagcaactataaactgacatttggaaaaggaactctcttaaccgtgaatccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 140 - DNA, 1809 bp, Artificial Sequence
  TCR 60 Nativefull sequence with mouse constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatcagtcggacagtctcctacgagcagtacttcgggccgggcaccaggctcacggtcacagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatgttggggagtggaggtagcaactataaactgacatttggaaaaggaactctcttaaccgtgaatccaaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 141 - protein, 609 aa, Artificial Sequence
  TCR 60 Full sequence with human constant
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAISRTVSYEQYFGPGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNMLGSGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 142 - protein, 601 aa, Artificial Sequence
  TCR 60 Full sequence with mouse constant
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAISRTVSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNMLGSGGSNYKLTFGKGTLLTVNPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 143 - DNA, 828 bp, Artificial Sequence
  TCR 61 Alpha Native with Codon Optimized Human Constant
atgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatagagaataacaatgccagactcatgtttggagatggaactcagctggtggtgaagcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 144 - DNA, 816 bp, Artificial Sequence
  TCR 61 Alpha Native with Codon Optimized Mouse Constant
atgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatagagaataacaatgccagactcatgtttggagatggaactcagctggtggtgaagcccaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 145 - protein, 253 aa, Artificial Sequence
  TCR 61 Alpha with Codon Optimized Human Constant
QKEVEQNSGPLSVPEGAIASLNCTYSDRGSQSFFWYRQYSGKSPELIMFIYSNGDKEDGRFTAQLNKASQYVSLLIRDSQPSDSATYLCAVNIENNNARLMFGDGTQLVVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 146 - protein, 249 aa, Artificial Sequence
  TCR 61 Alpha with Codon Optimized Mouse Constant
QKEVEQNSGPLSVPEGAIASLNCTYSDRGSQSFFWYRQYSGKSPELIMFIYSNGDKEDGRFTAQLNKASQYVSLLIRDSQPSDSATYLCAVNIENNNARLMFGDGTQLVVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 147 - protein, 275 aa, Artificial Sequence
  TCR 61 Alpha with Codon Optimized Human Constant and signal peptide
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNIENNNARLMFGDGTQLVVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 148 - protein, 271 aa, Artificial Sequence
  TCR 61 Alpha with Codon Optimized Mouse Constant and signal peptide
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNIENNNARLMFGDGTQLVVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 149 - protein, 112 aa, Artificial Sequence
  TCR 61 Alpha variable region
QKEVEQNSGPLSVPEGAIASLNCTYSDRGSQSFFWYRQYSGKSPELIMFIYSNGDKEDGRFTAQLNKASQYVSLLIRDSQPSDSATYLCAVNIENNNARLMFGDGTQLVVKP

SEQ ID NO: 150 - protein, 12 aa, Artificial Sequence
  TCR 61 Alpha CDR3
AVNIENNNARLM

SEQ ID NO: 151 - DNA, 930 bp, Artificial Sequence
  TCR 61 Beta Native with Codon Optimized Human Constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccaaacgttttagctacgagcagtacttcgggccgggcaccaggctcacggtcacagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa

SEQ ID NO: 152 - DNA, 918 bp, Artificial Sequence
  TCR 61 Beta Native with Codon Optimized Mouse Constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccaaacgttttagctacgagcagtacttcgggccgggcaccaggctcacggtcacagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaa

SEQ ID NO: 153 - protein, 290 aa, Artificial Sequence
  TCR 61 Beta with Codon Optimized Human Constant
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTKRFSYEQYFGPGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 154 - protein, 286 aa, Artificial Sequence
  TCR 61 Beta with Codon Optimized Mouse Constant
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTKRFSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 155 - protein, 309 aa, Artificial Sequence
  TCR 61 Beta with Codon Optimized Human Constant and signal peptide
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTKRFSYEQYFGPGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 156 - protein, 305 aa, Artificial Sequence
  TCR 61 Beta with Codon Optimized Mouse Constant and signal peptide
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTKRFSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 157 - protein, 113 aa, Artificial Sequence
  TCR 61 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTKRFSYEQYFGPGTRLTVT

SEQ ID NO: 158 - protein, 11 aa, Artificial Sequence
  TCR 61 Beta CDR3
ASTKRFSYEQY

SEQ ID NO: 159 - DNA, 1824 bp, Artificial Sequence
  TCR 61 Native full sequence with human constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccaaacgttttagctacgagcagtacttcgggccgggcaccaggctcacggtcacagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatagagaataacaatgccagactcatgtttggagatggaactcagctggtggtgaagcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 160 - DNA, 1800 bp, Artificial Sequence
  TCR 61 Nativefull sequence with mouse constant
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccaaacgttttagctacgagcagtacttcgggccgggcaccaggctcacggtcacagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatagagaataacaatgccagactcatgtttggagatggaactcagctggtggtgaagcccaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 161 - protein, 606 aa, Artificial Sequence
  TCR 61 Full sequence with human constant
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTKRFSYEQYFGPGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNIENNNARLMFGDGTQLVVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 162 - protein, 598 aa, Artificial Sequence
  TCR 61 Full sequence with mouse constant
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTKRFSYEQYFGPGTRLTVTEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNIENNNARLMFGDGTQLVVKPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 163 - DNA, 819 bp, Artificial Sequence
  TCR 62 Alpha Native with Codon Optimized Human Constant
atgacacgagttagcttgctgtgggcagtcgtggtctccacctgtcttgaatccggcatggcccagacagtcactcagtctcaaccagagatgtctgtgcaggaggcagagactgtgaccctgagttgcacatatgacaccagtgagaataattattatttgttctggtacaagcagcctcccagcaggcagatgattctcgttattcgccaagaagcttataagcaacagaatgcaacggagaatcgtttctctgtgaacttccagaaagcagccaaatccttcagtctcaagatctcagactcacagctgggggacactgcgatgtatttctgtgctctctatacctacaaatacatctttggaacaggcaccaggctgaaggttttagcaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 164 - DNA, 807 bp, Artificial Sequence
  TCR 62 Alpha Native with Codon Optimized Mouse Constant
atgacacgagttagcttgctgtgggcagtcgtggtctccacctgtcttgaatccggcatggcccagacagtcactcagtctcaaccagagatgtctgtgcaggaggcagagactgtgaccctgagttgcacatatgacaccagtgagaataattattatttgttctggtacaagcagcctcccagcaggcagatgattctcgttattcgccaagaagcttataagcaacagaatgcaacggagaatcgtttctctgtgaacttccagaaagcagccaaatccttcagtctcaagatctcagactcacagctgggggacactgcgatgtatttctgtgctctctatacctacaaatacatctttggaacaggcaccaggctgaaggttttagcaaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 165 - protein, 252 aa, Artificial Sequence
  TCR 62 Alpha with Codon Optimized Human Constant
AQTVTQSQPEMSVQEAETVTLSCTYDTSENNYYLFWYKQPPSRQMILVIRQEAYKQQNATENRFSVNFQKAAKSFSLKISDSQLGDTAMYFCALYTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 166 - protein, 248 aa, Artificial Sequence
  TCR 62 Alpha with Codon Optimized Mouse Constant
AQTVTQSQPEMSVQEAETVTLSCTYDTSENNYYLFWYKQPPSRQMILVIRQEAYKQQNATENRFSVNFQKAAKSFSLKISDSQLGDTAMYFCALYTYKYIFGTGTRLKVLANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 167 - protein, 272 aa, Artificial Sequence
  TCR 62 Alpha with Codon Optimized Human Constant and signal peptide
MTRVSLLWAVVVSTCLESGMAQTVTQSQPEMSVQEAETVTLSCTYDTSENNYYLFWYKQPPSRQMILVIRQEAYKQQNATENRFSVNFQKAAKSFSLKISDSQLGDTAMYFCALYTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 168 - protein, 268 aa, Artificial Sequence
  TCR 62 Alpha with Codon Optimized Mouse Constant and signal peptide
MTRVSLLWAVVVSTCLESGMAQTVTQSQPEMSVQEAETVTLSCTYDTSENNYYLFWYKQPPSRQMILVIRQEAYKQQNATENRFSVNFQKAAKSFSLKISDSQLGDTAMYFCALYTYKYIFGTGTRLKVLANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 169 - protein, 111 aa, Artificial Sequence
  TCR 62 Alpha variable region
AQTVTQSQPEMSVQEAETVTLSCTYDTSENNYYLFWYKQPPSRQMILVIRQEAYKQQNATENRFSVNFQKAAKSFSLKISDSQLGDTAMYFCALYTYKYIFGTGTRLKVLA

SEQ ID NO: 170 - protein, 7 aa, Artificial Sequence
  TCR 62 Alpha CDR1
TSENNYY

SEQ ID NO: 171 - protein, 8 aa, Artificial Sequence
  TCR 62 Alpha CDR2
QEAYKQQN

SEQ ID NO: 172 - protein, 8 aa, Artificial Sequence
  TCR 62 Alpha CDR3
ALYTYKYI

SEQ ID NO: 173 - protein, 20 aa, Artificial Sequence
  TCR 62 Alpha Signal peptide
MTRVSLLWAVVVSTCLESGM

SEQ ID NO: 174 - DNA, 942 bp, Artificial Sequence
  TCR 62 Beta Native with Codon Optimized Human Constant
atgggcaccaggctcctctgctgggcggccctctgtctcctgggagcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcttagatacccggggctcctcctacaatgagcagttcttcgggccagggacacggctcaccgtgctagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa

SEQ ID NO: 175 - DNA, 930 bp, Artificial Sequence
  TCR 62 Beta Native with Codon Optimized Mouse Constant
atgggcaccaggctcctctgctgggcggccctctgtctcctgggagcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcttagatacccggggctcctcctacaatgagcagttcttcgggccagggacacggctcaccgtgctagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaa

SEQ ID NO: 176 - protein, 294 aa, Artificial Sequence
  TCR 62 Beta with Codon Optimized Human Constant
EAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDTRGSSYNEQFFGPGTRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 177 - protein, 290 aa, Artificial Sequence
  TCR 62 Beta with Codon Optimized Mouse Constant
EAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDTRGSSYNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 178 - protein, 313 aa, Artificial Sequence
  TCR 62 Beta with Codon Optimized Human Constant and signal peptide
MGTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDTRGSSYNEQFFGPGTRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 179 - protein, 309 aa, Artificial Sequence
  TCR 62 Beta with Codon Optimized Mouse Constant and signal peptide
MGTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDTRGSSYNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 180 - protein, 117 aa, Artificial Sequence
  TCR 62 Beta variable region
EAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDTRGSSYNEQFFGPGTRLTVL

SEQ ID NO: 181 - protein, 5 aa, Artificial Sequence
  TCR 62 Beta CDR1
SGHAT

SEQ ID NO: 182 - protein, 6 aa, Artificial Sequence
  TCR 62 Beta CDR2
FQNNGV

SEQ ID NO: 183 - protein, 15 aa, Artificial Sequence
  TCR 62 Beta CDR3
ASSLDTRGSSYNEQF

SEQ ID NO: 184 - protein, 19 aa, Artificial Sequence
  TCR 62 Beta signal peptide
MGTRLLCWAALCLLGAELT

SEQ ID NO: 185 - DNA, 1827 bp, Artificial Sequence
  TCR 62 Native full sequence with human constant
atgggcaccaggctcctctgctgggcggccctctgtctcctgggagcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcttagatacccggggctcctcctacaatgagcagttcttcgggccagggacacggctcaccgtgctagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatgacacgagttagcttgctgtgggcagtcgtggtctccacctgtcttgaatccggcatggcccagacagtcactcagtctcaaccagagatgtctgtgcaggaggcagagactgtgaccctgagttgcacatatgacaccagtgagaataattattatttgttctggtacaagcagcctcccagcaggcagatgattctcgttattcgccaagaagcttataagcaacagaatgcaacggagaatcgtttctctgtgaacttccagaaagcagccaaatccttcagtctcaagatctcagactcacagctgggggacactgcgatgtatttctgtgctctctatacctacaaatacatctttggaacaggcaccaggctgaaggttttagcaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 186 - DNA, 1803 bp, Artificial Sequence
  TCR 62 Nativefull sequence with mouse constant
atgggcaccaggctcctctgctgggcggccctctgtctcctgggagcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcttagatacccggggctcctcctacaatgagcagttcttcgggccagggacacggctcaccgtgctagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatgacacgagttagcttgctgtgggcagtcgtggtctccacctgtcttgaatccggcatggcccagacagtcactcagtctcaaccagagatgtctgtgcaggaggcagagactgtgaccctgagttgcacatatgacaccagtgagaataattattatttgttctggtacaagcagcctcccagcaggcagatgattctcgttattcgccaagaagcttataagcaacagaatgcaacggagaatcgtttctctgtgaacttccagaaagcagccaaatccttcagtctcaagatctcagactcacagctgggggacactgcgatgtatttctgtgctctctatacctacaaatacatctttggaacaggcaccaggctgaaggttttagcaaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 187 - protein, 607 aa, Artificial Sequence
  TCR 62 Full sequence with human constant
MGTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDTRGSSYNEQFFGPGTRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMTRVSLLWAVVVSTCLESGMAQTVTQSQPEMSVQEAETVTLSCTYDTSENNYYLFWYKQPPSRQMILVIRQEAYKQQNATENRFSVNFQKAAKSFSLKISDSQLGDTAMYFCALYTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 188 - protein, 599 aa, Artificial Sequence
  TCR 62 Full sequence with mouse constant
MGTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDTRGSSYNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSGSGATNFSLLKQAGDVEENPGPMTRVSLLWAVVVSTCLESGMAQTVTQSQPEMSVQEAETVTLSCTYDTSENNYYLFWYKQPPSRQMILVIRQEAYKQQNATENRFSVNFQKAAKSFSLKISDSQLGDTAMYFCALYTYKYIFGTGTRLKVLANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 189 - DNA, 816 bp, Artificial Sequence
  TCR 63 Alpha Native with Codon Optimized Human Constant
atggagactgttctgcacgtactcctagggatattggggttccaagcagcctgggtcagtagccaagaactggagcagagtcctcagtccttgatcgtccaagagggaaagaatctcaccataaactgcacgtcatcaaagacgttatatggcttatactggtataagcaaaagtatggtgaaggtcttatcttcttgatgatgctacagaaaggtggggaagagaaaagtcatgaaaagataactgccaagttggatgagaaaaagcagcaaagttccctgcatatcacagcctcccagcccagccatgcaggcatctacctctgtggagcagacatagacgactacaagctcagctttggagccggaaccacagtaactgtaagagcaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 190 - DNA, 804 bp, Artificial Sequence
  TCR 63 Alpha Native with Codon Optimized Mouse Constant
atggagactgttctgcacgtactcctagggatattggggttccaagcagcctgggtcagtagccaagaactggagcagagtcctcagtccttgatcgtccaagagggaaagaatctcaccataaactgcacgtcatcaaagacgttatatggcttatactggtataagcaaaagtatggtgaaggtcttatcttcttgatgatgctacagaaaggtggggaagagaaaagtcatgaaaagataactgccaagttggatgagaaaaagcagcaaagttccctgcatatcacagcctcccagcccagccatgcaggcatctacctctgtggagcagacatagacgactacaagctcagctttggagccggaaccacagtaactgtaagagcaaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 191 - protein, 251 aa, Artificial Sequence
  TCR 63 Alpha with Codon Optimized Human Constant
SQELEQSPQSLIVQEGKNLTINCTSSKTLYGLYWYKQKYGEGLIFLMMLQKGGEEKSHEKITAKLDEKKQQSSLHITASQPSHAGIYLCGADIDDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 192 - protein, 247 aa, Artificial Sequence
  TCR 63 Alpha with Codon Optimized Mouse Constant
SQELEQSPQSLIVQEGKNLTINCTSSKTLYGLYWYKQKYGEGLIFLMMLQKGGEEKSHEKITAKLDEKKQQSSLHITASQPSHAGIYLCGADIDDYKLSFGAGTTVTVRANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 193 - protein, 271 aa, Artificial Sequence
  TCR 63 Alpha with Codon Optimized Human Constant and signal peptide
METVLHVLLGILGFQAAWVSSQELEQSPQSLIVQEGKNLTINCTSSKTLYGLYWYKQKYGEGLIFLMMLQKGGEEKSHEKITAKLDEKKQQSSLHITASQPSHAGIYLCGADIDDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 194 - protein, 267 aa, Artificial Sequence
  TCR 63 Alpha with Codon Optimized Mouse Constant and signal peptide
METVLHVLLGILGFQAAWVSSQELEQSPQSLIVQEGKNLTINCTSSKTLYGLYWYKQKYGEGLIFLMMLQKGGEEKSHEKITAKLDEKKQQSSLHITASQPSHAGIYLCGADIDDYKLSFGAGTTVTVRANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 195 - protein, 110 aa, Artificial Sequence
  TCR 63 Alpha variable region
SQELEQSPQSLIVQEGKNLTINCTSSKTLYGLYWYKQKYGEGLIFLMMLQKGGEEKSHEKITAKLDEKKQQSSLHITASQPSHAGIYLCGADIDDYKLSFGAGTTVTVRA

SEQ ID NO: 196 - protein, 5 aa, Artificial Sequence
  TCR 63 Alpha CDR1
KTLYG

SEQ ID NO: 197 - protein, 7 aa, Artificial Sequence
  TCR 63 Alpha CDR2
LQKGGEE

SEQ ID NO: 198 - protein, 10 aa, Artificial Sequence
  TCR 63 Alpha CDR3
GADIDDYKLS

SEQ ID NO: 199 - protein, 20 aa, Artificial Sequence
  TCR 63 Alpha Signal peptide
METVLHVLLGILGFQAAWVS

SEQ ID NO: 200 - DNA, 939 bp, Artificial Sequence
  TCR 63 Beta Native with Codon Optimized Human Constant
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagaccaagacaggggtataatgacaatgagcagttcttcgggccagggacacggctcaccgtgctagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa

SEQ ID NO: 201 - DNA, 927 bp, Artificial Sequence
  TCR 63 Beta Native with Codon Optimized Mouse Constant
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagaccaagacaggggtataatgacaatgagcagttcttcgggccagggacacggctcaccgtgctagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaa

SEQ ID NO: 202 - protein, 293 aa, Artificial Sequence
  TCR 63 Beta with Codon Optimized Human Constant
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASRPRQGYNDNEQFFGPGTRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 203 - protein, 289 aa, Artificial Sequence
  TCR 63 Beta with Codon Optimized Mouse Constant
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASRPRQGYNDNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 204 - protein, 312 aa, Artificial Sequence
  TCR 63 Beta with Codon Optimized Human Constant and signal peptide
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASRPRQGYNDNEQFFGPGTRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 205 - protein, 308 aa, Artificial Sequence
  TCR 63 Beta with Codon Optimized Mouse Constant and signal peptide
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASRPRQGYNDNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 206 - protein, 116 aa, Artificial Sequence
  TCR 63 Beta variable region
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASRPRQGYNDNEQFFGPGTRLTVL

SEQ ID NO: 207 - protein, 5 aa, Artificial Sequence
  TCR 63 Beta CDR1
SGHVS

SEQ ID NO: 208 - protein, 6 aa, Artificial Sequence
  TCR 63 Beta CDR2
FQNEAQ

SEQ ID NO: 209 - protein, 14 aa, Artificial Sequence
  TCR 63 Beta CDR3
ASRPRQGYNDNEQF

SEQ ID NO: 210 - protein, 19 aa, Artificial Sequence
  TCR 63 Beta signal peptide
MGTRLLCWVVLGFLGTDHT

SEQ ID NO: 211 - DNA, 1821 bp, Artificial Sequence
  TCR 63 Native full sequence with human constant
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagaccaagacaggggtataatgacaatgagcagttcttcgggccagggacacggctcaccgtgctagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatggagactgttctgcacgtactcctagggatattggggttccaagcagcctgggtcagtagccaagaactggagcagagtcctcagtccttgatcgtccaagagggaaagaatctcaccataaactgcacgtcatcaaagacgttatatggcttatactggtataagcaaaagtatggtgaaggtcttatcttcttgatgatgctacagaaaggtggggaagagaaaagtcatgaaaagataactgccaagttggatgagaaaaagcagcaaagttccctgcatatcacagcctcccagcccagccatgcaggcatctacctctgtggagcagacatagacgactacaagctcagctttggagccggaaccacagtaactgtaagagcaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 212 - DNA, 1797 bp, Artificial Sequence
  TCR 63 Nativefull sequence with mouse constant
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagaccaagacaggggtataatgacaatgagcagttcttcgggccagggacacggctcaccgtgctagaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatggagactgttctgcacgtactcctagggatattggggttccaagcagcctgggtcagtagccaagaactggagcagagtcctcagtccttgatcgtccaagagggaaagaatctcaccataaactgcacgtcatcaaagacgttatatggcttatactggtataagcaaaagtatggtgaaggtcttatcttcttgatgatgctacagaaaggtggggaagagaaaagtcatgaaaagataactgccaagttggatgagaaaaagcagcaaagttccctgcatatcacagcctcccagcccagccatgcaggcatctacctctgtggagcagacatagacgactacaagctcagctttggagccggaaccacagtaactgtaagagcaaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 213 - protein, 605 aa, Artificial Sequence
  TCR 63 Full sequence with human constant
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASRPRQGYNDNEQFFGPGTRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMETVLHVLLGILGFQAAWVSSQELEQSPQSLIVQEGKNLTINCTSSKTLYGLYWYKQKYGEGLIFLMMLQKGGEEKSHEKITAKLDEKKQQSSLHITASQPSHAGIYLCGADIDDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 214 - protein, 597 aa, Artificial Sequence
  TCR 63 Full sequence with mouse constant
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASRPRQGYNDNEQFFGPGTRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSGSGATNFSLLKQAGDVEENPGPMETVLHVLLGILGFQAAWVSSQELEQSPQSLIVQEGKNLTINCTSSKTLYGLYWYKQKYGEGLIFLMMLQKGGEEKSHEKITAKLDEKKQQSSLHITASQPSHAGIYLCGADIDDYKLSFGAGTTVTVRANIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 215 - DNA, 840 bp, Artificial Sequence
  TCR 64 Alpha Native with Codon Optimized Human Constant
atgaacatgctgactgccagcctgttgagggcagtcatagcctccatctgtgttgtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgagtggggtcgataactatggtcagaattttgtctttggtcccggaaccagattgtccgtgctgcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 216 - DNA, 828 bp, Artificial Sequence
  TCR 64 Alpha Native with Codon Optimized Mouse Constant
atgaacatgctgactgccagcctgttgagggcagtcatagcctccatctgtgttgtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgagtggggtcgataactatggtcagaattttgtctttggtcccggaaccagattgtccgtgctgcccaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 217 - protein, 257 aa, Artificial Sequence
  TCR 64 Alpha with Codon Optimized Human Constant
AQKVTQAQTEISVVEKEDVTLDCVYETRDTTYYLFWYKQPPSGELVFLIRRNSFDEQNEISGRYSWNFQKSTSSFNFTITASQVVDSAVYFCALSGVDNYGQNFVFGPGTRLSVLPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 218 - protein, 253 aa, Artificial Sequence
  TCR 64 Alpha with Codon Optimized Mouse Constant
AQKVTQAQTEISVVEKEDVTLDCVYETRDTTYYLFWYKQPPSGELVFLIRRNSFDEQNEISGRYSWNFQKSTSSFNFTITASQVVDSAVYFCALSGVDNYGQNFVFGPGTRLSVLPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 219 - protein, 279 aa, Artificial Sequence
  TCR 64 Alpha with Codon Optimized Human Constant and signal peptide
MNMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSGVDNYGQNFVFGPGTRLSVLPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 220 - protein, 275 aa, Artificial Sequence
  TCR 64 Alpha with Codon Optimized Mouse Constant and signal peptide
MNMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSGVDNYGQNFVFGPGTRLSVLPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 221 - protein, 116 aa, Artificial Sequence
  TCR 64 Alpha variable region
AQKVTQAQTEISVVEKEDVTLDCVYETRDTTYYLFWYKQPPSGELVFLIRRNSFDEQNEISGRYSWNFQKSTSSFNFTITASQVVDSAVYFCALSGVDNYGQNFVFGPGTRLSVLP

SEQ ID NO: 222 - protein, 7 aa, Artificial Sequence
  TCR 64 Alpha CDR1
TRDTTYY

SEQ ID NO: 223 - protein, 8 aa, Artificial Sequence
  TCR 64 Alpha CDR2
RNSFDEQN

SEQ ID NO: 224 - protein, 13 aa, Artificial Sequence
  TCR 64 Alpha CDR3
ALSGVDNYGQNFV

SEQ ID NO: 225 - protein, 22 aa, Artificial Sequence
  TCR 64 Alpha Signal peptide
MNMLTASLLRAVIASICVVSSM

SEQ ID NO: 226 - DNA, 933 bp, Artificial Sequence
  TCR 64 Beta Native with Codon Optimized Human Constant
atgggctgcaggctcctctgctgtgtggtcttctgcctcctccaagcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccagggggaagctggggccaacgtcctgactttcggggccggcagcaggctgaccgtgctggaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa

SEQ ID NO: 227 - DNA, 921 bp, Artificial Sequence
  TCR 64 Beta Native with Codon Optimized Mouse Constant
atgggctgcaggctcctctgctgtgtggtcttctgcctcctccaagcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccagggggaagctggggccaacgtcctgactttcggggccggcagcaggctgaccgtgctggaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaa

SEQ ID NO: 228 - protein, 291 aa, Artificial Sequence
  TCR 64 Beta with Codon Optimized Human Constant
DTAVSQTPKYLVTQMGNDKSIKCEQNLGHDTMYWYKQDSKKFLKIMFSYNNKELIINETVPNRFSPKSPDKAHLNLHINSLELGDSAVYFCASSQGEAGANVLTFGAGSRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 229 - protein, 287 aa, Artificial Sequence
  TCR 64 Beta with Codon Optimized Mouse Constant
DTAVSQTPKYLVTQMGNDKSIKCEQNLGHDTMYWYKQDSKKFLKIMFSYNNKELIINETVPNRFSPKSPDKAHLNLHINSLELGDSAVYFCASSQGEAGANVLTFGAGSRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 230 - protein, 310 aa, Artificial Sequence
  TCR 64 Beta with Codon Optimized Human Constant and signal peptide
MGCRLLCCVVFCLLQAGPLDTAVSQTPKYLVTQMGNDKSIKCEQNLGHDTMYWYKQDSKKFLKIMFSYNNKELIINETVPNRFSPKSPDKAHLNLHINSLELGDSAVYFCASSQGEAGANVLTFGAGSRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 231 - protein, 306 aa, Artificial Sequence
  TCR 64 Beta with Codon Optimized Mouse Constant and signal peptide
MGCRLLCCVVFCLLQAGPLDTAVSQTPKYLVTQMGNDKSIKCEQNLGHDTMYWYKQDSKKFLKIMFSYNNKELIINETVPNRFSPKSPDKAHLNLHINSLELGDSAVYFCASSQGEAGANVLTFGAGSRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 232 - protein, 114 aa, Artificial Sequence
  TCR 64 Beta variable region
DTAVSQTPKYLVTQMGNDKSIKCEQNLGHDTMYWYKQDSKKFLKIMFSYNNKELIINETVPNRFSPKSPDKAHLNLHINSLELGDSAVYFCASSQGEAGANVLTFGAGSRLTVL

SEQ ID NO: 233 - protein, 5 aa, Artificial Sequence
  TCR 64 Beta CDR1
LGHDT

SEQ ID NO: 234 - protein, 6 aa, Artificial Sequence
  TCR 64 Beta CDR2
YNNKEL

SEQ ID NO: 235 - protein, 13 aa, Artificial Sequence
  TCR 64 Beta CDR3
ASSQGEAGANVLT

SEQ ID NO: 236 - protein, 19 aa, Artificial Sequence
  TCR 64 Beta signal peptide
MGCRLLCCVVFCLLQAGPL

SEQ ID NO: 237 - DNA, 1839 bp, Artificial Sequence
  TCR 64 Native full sequence with human constant
atgggctgcaggctcctctgctgtgtggtcttctgcctcctccaagcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccagggggaagctggggccaacgtcctgactttcggggccggcagcaggctgaccgtgctggaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatgaacatgctgactgccagcctgttgagggcagtcatagcctccatctgtgttgtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgagtggggtcgataactatggtcagaattttgtctttggtcccggaaccagattgtccgtgctgcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 238 - DNA, 1815 bp, Artificial Sequence
  TCR 64 Nativefull sequence with mouse constant
atgggctgcaggctcctctgctgtgtggtcttctgcctcctccaagcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccagggggaagctggggccaacgtcctgactttcggggccggcagcaggctgaccgtgctggaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatgaacatgctgactgccagcctgttgagggcagtcatagcctccatctgtgttgtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgagtggggtcgataactatggtcagaattttgtctttggtcccggaaccagattgtccgtgctgcccaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 239 - protein, 611 aa, Artificial Sequence
  TCR 64 Full sequence with human constant
MGCRLLCCVVFCLLQAGPLDTAVSQTPKYLVTQMGNDKSIKCEQNLGHDTMYWYKQDSKKFLKIMFSYNNKELIINETVPNRFSPKSPDKAHLNLHINSLELGDSAVYFCASSQGEAGANVLTFGAGSRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMNMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSGVDNYGQNFVFGPGTRLSVLPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 240 - protein, 603 aa, Artificial Sequence
  TCR 64 Full sequence with mouse constant
MGCRLLCCVVFCLLQAGPLDTAVSQTPKYLVTQMGNDKSIKCEQNLGHDTMYWYKQDSKKFLKIMFSYNNKELIINETVPNRFSPKSPDKAHLNLHINSLELGDSAVYFCASSQGEAGANVLTFGAGSRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSGSGATNFSLLKQAGDVEENPGPMNMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSGVDNYGQNFVFGPGTRLSVLPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 241 - DNA, 828 bp, Artificial Sequence
  TCR 65 Alpha Native with Codon Optimized Human Constant
atggagaaaatgttggagtgtgcattcatagtcttgtggcttcagcttggctggttgagtggagaagaccaggtgacgcagagtcccgaggccctgagactccaggagggagagagtagcagtcttaactgcagttacacagtcagcggtttaagagggctgttctggtataggcaagatcctgggaaaggccctgaattcctcttcaccctgtattcagctggggaagaaaaggagaaagaaaggctaaaagccacattaacaaagaaggaaagctttctgcacatcacagcccctaaacctgaagactcagccacttatctctgtgctgtgcaggcagaaagaggctcaaccctggggaggctatactttggaagaggaactcagttgactgtctggcctaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 242 - DNA, 816 bp, Artificial Sequence
  TCR 65 Alpha Native with Codon Optimized Mouse Constant
atggagaaaatgttggagtgtgcattcatagtcttgtggcttcagcttggctggttgagtggagaagaccaggtgacgcagagtcccgaggccctgagactccaggagggagagagtagcagtcttaactgcagttacacagtcagcggtttaagagggctgttctggtataggcaagatcctgggaaaggccctgaattcctcttcaccctgtattcagctggggaagaaaaggagaaagaaaggctaaaagccacattaacaaagaaggaaagctttctgcacatcacagcccctaaacctgaagactcagccacttatctctgtgctgtgcaggcagaaagaggctcaaccctggggaggctatactttggaagaggaactcagttgactgtctggcctaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 243 - protein, 254 aa, Artificial Sequence
  TCR 65 Alpha with Codon Optimized Human Constant
EDQVTQSPEALRLQEGESSSLNCSYTVSGLRGLFWYRQDPGKGPEFLFTLYSAGEEKEKERLKATLTKKESFLHITAPKPEDSATYLCAVQAERGSTLGRLYFGRGTQLTVWPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 244 - protein, 250 aa, Artificial Sequence
  TCR 65 Alpha with Codon Optimized Mouse Constant
EDQVTQSPEALRLQEGESSSLNCSYTVSGLRGLFWYRQDPGKGPEFLFTLYSAGEEKEKERLKATLTKKESFLHITAPKPEDSATYLCAVQAERGSTLGRLYFGRGTQLTVWPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 245 - protein, 275 aa, Artificial Sequence
  TCR 65 Alpha with Codon Optimized Human Constant and signal peptide
MEKMLECAFIVLWLQLGWLSGEDQVTQSPEALRLQEGESSSLNCSYTVSGLRGLFWYRQDPGKGPEFLFTLYSAGEEKEKERLKATLTKKESFLHITAPKPEDSATYLCAVQAERGSTLGRLYFGRGTQLTVWPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 246 - protein, 271 aa, Artificial Sequence
  TCR 65 Alpha with Codon Optimized Mouse Constant and signal peptide
MEKMLECAFIVLWLQLGWLSGEDQVTQSPEALRLQEGESSSLNCSYTVSGLRGLFWYRQDPGKGPEFLFTLYSAGEEKEKERLKATLTKKESFLHITAPKPEDSATYLCAVQAERGSTLGRLYFGRGTQLTVWPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 247 - protein, 113 aa, Artificial Sequence
  TCR 65 Alpha variable region
EDQVTQSPEALRLQEGESSSLNCSYTVSGLRGLFWYRQDPGKGPEFLFTLYSAGEEKEKERLKATLTKKESFLHITAPKPEDSATYLCAVQAERGSTLGRLYFGRGTQLTVWP

SEQ ID NO: 248 - protein, 6 aa, Artificial Sequence
  TCR 65 Alpha CDR1
VSGLRG

SEQ ID NO: 249 - protein, 7 aa, Artificial Sequence
  TCR 65 Alpha CDR2
LYSAGEE

SEQ ID NO: 250 - protein, 14 aa, Artificial Sequence
  TCR 65 Alpha CDR3
AVQAERGSTLGRLY

SEQ ID NO: 251 - protein, 21 aa, Artificial Sequence
  TCR 65 Alpha Signal peptide
MEKMLECAFIVLWLQLGWLSG

SEQ ID NO: 252 - DNA, 936 bp, Artificial Sequence
  TCR 65 Beta Native with Codon Optimized Human Constant
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggacggcgaaacaccggggagctgttttttggagaaggctctaggctgaccgtactggaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaa

SEQ ID NO: 253 - DNA, 924 bp, Artificial Sequence
  TCR 65 Beta Native with Codon Optimized Mouse Constant
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggacggcgaaacaccggggagctgttttttggagaaggctctaggctgaccgtactggaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaa

SEQ ID NO: 254 - protein, 292 aa, Artificial Sequence
  TCR 65 Beta with Codon Optimized Human Constant
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRRNTGELFFGEGSRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 255 - protein, 288 aa, Artificial Sequence
  TCR 65 Beta with Codon Optimized Mouse Constant
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRRNTGELFFGEGSRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 256 - protein, 311 aa, Artificial Sequence
  TCR 65 Beta with Codon Optimized Human Constant and signal peptide
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRRNTGELFFGEGSRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 257 - protein, 307 aa, Artificial Sequence
  TCR 65 Beta with Codon Optimized Mouse Constant and signal peptide
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRRNTGELFFGEGSRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 258 - protein, 115 aa, Artificial Sequence
  TCR 65 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRRNTGELFFGEGSRLTVL

SEQ ID NO: 259 - protein, 5 aa, Artificial Sequence
  TCR 65 Beta CDR1
MDHEN

SEQ ID NO: 260 - protein, 6 aa, Artificial Sequence
  TCR 65 Beta CDR2
SYDVKM

SEQ ID NO: 261 - protein, 14 aa, Artificial Sequence
  TCR 65 Beta CDR3
ASSLWGRRNTGELF

SEQ ID NO: 262 - protein, 19 aa, Artificial Sequence
  TCR 65 Beta signal peptide
MGIRLLCRVAFCFLAVGLV

SEQ ID NO: 263 - DNA, 1830 bp, Artificial Sequence
  TCR 65 Native full sequence with human constant
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggacggcgaaacaccggggagctgttttttggagaaggctctaggctgaccgtactggaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatggagaaaatgttggagtgtgcattcatagtcttgtggcttcagcttggctggttgagtggagaagaccaggtgacgcagagtcccgaggccctgagactccaggagggagagagtagcagtcttaactgcagttacacagtcagcggtttaagagggctgttctggtataggcaagatcctgggaaaggccctgaattcctcttcaccctgtattcagctggggaagaaaaggagaaagaaaggctaaaagccacattaacaaagaaggaaagctttctgcacatcacagcccctaaacctgaagactcagccacttatctctgtgctgtgcaggcagaaagaggctcaaccctggggaggctatactttggaagaggaactcagttgactgtctggcctaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 264 - DNA, 1806 bp, Artificial Sequence
  TCR 65 Nativefull sequence with mouse constant
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggacggcgaaacaccggggagctgttttttggagaaggctctaggctgaccgtactggaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatggagaaaatgttggagtgtgcattcatagtcttgtggcttcagcttggctggttgagtggagaagaccaggtgacgcagagtcccgaggccctgagactccaggagggagagagtagcagtcttaactgcagttacacagtcagcggtttaagagggctgttctggtataggcaagatcctgggaaaggccctgaattcctcttcaccctgtattcagctggggaagaaaaggagaaagaaaggctaaaagccacattaacaaagaaggaaagctttctgcacatcacagcccctaaacctgaagactcagccacttatctctgtgctgtgcaggcagaaagaggctcaaccctggggaggctatactttggaagaggaactcagttgactgtctggcctaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 265 - protein, 608 aa, Artificial Sequence
  TCR 65 Full sequence with human constant
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRRNTGELFFGEGSRLTVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMEKMLECAFIVLWLQLGWLSGEDQVTQSPEALRLQEGESSSLNCSYTVSGLRGLFWYRQDPGKGPEFLFTLYSAGEEKEKERLKATLTKKESFLHITAPKPEDSATYLCAVQAERGSTLGRLYFGRGTQLTVWPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 266 - protein, 600 aa, Artificial Sequence
  TCR 65 Full sequence with mouse constant
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRRNTGELFFGEGSRLTVLEDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNSGSGATNFSLLKQAGDVEENPGPMEKMLECAFIVLWLQLGWLSGEDQVTQSPEALRLQEGESSSLNCSYTVSGLRGLFWYRQDPGKGPEFLFTLYSAGEEKEKERLKATLTKKESFLHITAPKPEDSATYLCAVQAERGSTLGRLYFGRGTQLTVWPNIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 267 - protein, 9 aa, Human papillomavirus
  E6(18-26) peptide
KLPQLCTEL

SEQ ID NO: 268 - protein, 10 aa, Human papillomavirus
  E6(29-38) peptide
TIHDIILECV

SEQ ID NO: 269 - protein, 9 aa, Human papillomavirus
  E6(52-60) peptide
FAFRDLCIV

SEQ ID NO: 270 - protein, 8 aa, Human papillomavirus
  E7(86-93) peptide
TLGIVCPI

SEQ ID NO: 271 - protein, 9 aa, Human papillomavirus
  E7(11-19) peptide
YMLDLQPET

SEQ ID NO: 272 - protein, 9 aa, Human papillomavirus
  E7(85-93) peptide
GTLGIVCPI

SEQ ID NO: 273 - protein, 9 aa, Human papillomavirus
  E7(82-90) peptide
LLMGTLGIV

SEQ ID NO: 274 - protein, 9 aa, Human papillomavirus
  E7(7-15) peptide
TLHEYMLDL

SEQ ID NO: 275 - protein, 137 aa, Mus musculus
  Mouse alpha constant
DIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSS

SEQ ID NO: 276 - protein, 137 aa, Mus musculus
  Mouse alpha constant
NIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSS

SEQ ID NO: 277 - protein, 137 aa, Mus musculus; identical to SEQ ID NO: 15
  Transmembrane-modified/cysteine modified mouse constant alpha

SEQ ID NO: 278 - protein, 136 aa, Mus musculus
  Mouse alpha constant
IQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 279 - protein, 137 aa, Mus musculus; identical to SEQ ID NO: 276
  Mouse alpha constant

SEQ ID NO: 280 - protein, 137 aa, Mus musculus
  Mouse alpha constant
  VARIANT (48)...(48): X = unknown or other
  VARIANT (112)...(112): X = unknown or other
  VARIANT (114)...(114): X = unknown or other
  VARIANT (115)...(115): X = unknown or other
NIQNPEPAVYQLKDPRSQDSTLCLFTDFDSQINVPKTMESGTFITDKXVLDMKAMDSKSNGAIAWSNQTSFTCQDIFKETNATYPSSDVPCDATLTEKSFETDMNLNFQNLXVXXLRILLLKVAGFNLLMTLRLWSS

SEQ ID NO: 281 - protein, 137 aa, Mus musculus
  Mouse alpha constant
NIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLSVMGLRILLLKVAGFNLLMTLRLWSS

SEQ ID NO: 282 - protein, 137 aa, Mus musculus
  Mouse alpha constant
NIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 283 - protein, 172 aa, Mus musculus
  Mouse beta constant
DLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYHQGVLSATILYEILLGKATLYAVLVSGLVLMAMVKRKNS

SEQ ID NO: 284 - protein, 173 aa, Mus musculus
  Mouse beta constant
EDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 285 - protein, 173 aa, Mus musculus
  Mouse beta constant
  VARIANT (57)...(57): X = unknown or other
EDLRNVTPPKVSLFEPSKAEIANKQKATLVCLARGFFPDHVELSWWVNGKEVHSGVXTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 286 - protein, 21 aa, Artificial Sequence
  Signal Sequence
MKTFAGFSFLFLWLQLDCMSR

SEQ ID NO: 287 - protein, 10 aa, Artificial Sequence
  Linker
  REPEAT (5)...(9): SGGGG is repeated 5 or 6 times
PGGGSGGGGP

SEQ ID NO: 288 - protein, 17 aa, Artificial Sequence
  Linker
GSADDAKKDAAKKDGKS

SEQ ID NO: 289 - protein, 13 aa, Artificial Sequence
  TCR E7(11-19) beta overall CDR3 consensus
  VARIANT (1)...(1): Xaa = A or S
  VARIANT (2)...(2): Xaa = A, I, S, or Y
  VARIANT (3)...(3): Xaa = S, T, or R
  VARIANT (4)...(4): Xaa = G, K, R, L, P, S, or Q
  VARIANT (5)...(5): Xaa = D, G, R, T, or W
  VARIANT (6)...(6): Xaa = A, E, F, R, S, Q, T or V
  VARIANT (7)...(7): Xaa = A, R, G, Y, or null
  VARIANT (8)...(8): Xaa = G, N, S, or null
  VARIANT (9)...(9): Xaa = A, D, G, S, or Y
  VARIANT (10)...(10): Xaa = L, N, or Y
  VARIANT (11)...(11): Xaa = E or V
  VARIANT (12)...(12): Xaa = L or Q
  VARIANT (13)...(13): Xaa = F, Y, or T
XXXXXXXXXXXXX

SEQ ID NO: 290 - protein, 13 aa, Artificial Sequence
  TCR E7(11-19) beta CDR3 consensus
  VARIANT (1)...(1): Xaa = A or S
  VARIANT (2)...(2): Xaa = A or S
  VARIANT (3)...(3): Xaa = S or R
  VARIANT (4)...(4): Xaa = S, L, or P
  VARIANT (5)...(5): Xaa = W, D, or R
  VARIANT (6)...(6): Xaa = R, T, or Q
  VARIANT (7)...(7): Xaa = R, G, Y, or null
  VARIANT (8)...(8): Xaa = G, N, or S
  VARIANT (9)...(9): Xaa = G, D, or Y
  VARIANT (10)...(10): Xaa = N or L
XXXXXXXXXXEQF

SEQ ID NO: 291 - protein, 11 aa, Artificial Sequence
  TCR E7(11-19) beta CDR3 consensus
  VARIANT (1)...(1): Xaa = A or S
  VARIANT (2)...(2): Xaa = I, S, or Y
  VARIANT (3)...(3): Xaa = S or T
  VARIANT (4)...(4): Xaa = G, P, R, or T
  VARIANT (5)...(5): Xaa = R or T
  VARIANT (6)...(6): Xaa = F, S, A, or V
  VARIANT (7)...(7): Xaa = S or T
XXXXXXXYEQY

SEQ ID NO: 292 - protein, 13 aa, Artificial Sequence
  TCR E7(11-19) alpha overall CDR3 consensus
  VARIANT (1)...(1): Xaa = A or G
  VARIANT (2)...(2): Xaa = A, G, P, V, or L
  VARIANT (3)...(3): Xaa = A, K, N, Y, D, or S
  VARIANT (4)...(4): Xaa = R, M, I, T, or G
  VARIANT (5)...(5): Xaa = N, E, L, D, V, or null
  VARIANT (6)...(6): Xaa = Y, G, N, D, or null
  VARIANT (7)...(7): Xaa = S, N, G, or null
  VARIANT (8)...(8): Xaa = G, N, Y, or null
  VARIANT (9)...(9): Xaa = D, F, G, N, or null
  VARIANT (10)...(10): Xaa =A, N, Q, or Y
  VARIANT (11)...(11): Xaa = K, R, or N
  VARIANT (12)...(12): Xaa = F, L, or Y
  VARIANT (13)...(13): Xaa = I, M, S, T, V, or Y
XXXXXXXXXXXXX

SEQ ID NO: 293 - protein, 13 aa, Artificial Sequence
  TCR E7(11-19) alpha CDR3 consensus
  VARIANT (4)...(4): Xaa = M or I
  VARIANT (5)...(5): Xaa = E or L
  VARIANT (6)...(6): Xaa = G or N
  VARIANT (7)...(7): Xaa = S, G, or null
  VARIANT (8)...(8): Xaa = S or N
  VARIANT (10)...(10): Xaa =Y or A
  VARIANT (11)...(11): Xaa = K or R
  VARIANT (13)...(13): Xaa = T or M
AVNXXXXXNXXLX

SEQ ID NO: 294 - protein, 19 aa, Artificial Sequence
  Signal Sequence
MDTWLVCWAIFSLLKAGLT

SEQ ID NO: 295 - DNA, 36 bp, Homo sapiens
  spacer (IgG4hinge)
gaatctaagtacggaccgccctgccccccttgccct

SEQ ID NO: 296 - protein, 119 aa, Homo sapiens
  Hinge-CH3 spacer
ESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 297 - protein, 229 aa, Homo sapiens
  Hinge-CH2-CH3 spacer
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 298 - protein, 282 aa, Homo sapiens
  IgD-hinge-Fc
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 299 - protein, 357 aa, Artificial Sequence
  tEGFR
MLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 300 - protein, 335 aa, Artificial Sequence
  tEGFR
RKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 301 - protein, 24 aa, Artificial Sequence
  T2A
LEGGGEGRGSLLTCGDVEENPGPR

SEQ ID NO: 302 - protein, 18 aa, Artificial Sequence
  T2A
EGRGSLLTCGDVEENPGP

SEQ ID NO: 303 - protein, 27 aa, Homo sapiens
  CD28
FWVLVVVGGVLACYSLLVTVAFIIFWV

SEQ ID NO: 304 - protein, 66 aa, Homo sapiens
  CD28
IEVMYPPPYLDNEKSNGTIIHVKGKHLCPSPLFPGPSKPFWVLVVVGGVLACYSLLVTVAFIIFWV

SEQ ID NO: 305 - protein, 41 aa, Homo sapiens
  CD28
RSKRSRLLHSDYMNMTPRRPGPTRKHYQPYAPPRDFAAYRS

SEQ ID NO: 306 - protein, 41 aa, Homo sapiens
  CD28
RSKRSRGGHSDYMNMTPRRPGPTRKHYQPYAPPRDFAAYRS

SEQ ID NO: 307 - protein, 42 aa, Homo sapiens
  4-1BB
KRGRKKLLYIFKQPFMRPVQTTQEEDGCSCRFPEEEEGGCEL

SEQ ID NO: 308 - protein, 112 aa, Homo sapiens
  CD3 zeta
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 309 - protein, 112 aa, Homo sapiens
  CD3 zeta
RVKFSRSAEPPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 310 - protein, 112 aa, Homo sapiens
  CD3 zeta
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 311 - protein, 19 aa, Artificial Sequence
  P2A
ATNFSLLKQAGDVEENPGP

SEQ ID NO: 312 - protein, 22 aa, Artificial Sequence
  F2A
VKQTLNFDLLKLAGDVESNPGP

SEQ ID NO: 313 - protein, 20 aa, Artificial Sequence
  E2A
QCTNYALLKLAGDVESNPGP

SEQ ID NO: 314 - protein, 12 aa, Homo sapiens
  spacer (IgG4hinge)
ESKYGPPCPPCP

SEQ ID NO: 315 - DNA, 66 bp, Artificial Sequence
  P2A
ggctccggcgccacaaacttttctctgctgaagcaggcaggcgatgtggaggagaaccctggacca

SEQ ID NO: 316 - DNA, 66 bp, Artificial Sequence
  P2A
ggaagcggagccaccaacttttccctgctgaagcaggccggcgatgtggaggagaatcctggccca

SEQ ID NO: 317 - DNA, 66 bp, Artificial Sequence
  P2A
ggatctggagccaccaacttctccctgctgaagcaggccggcgatgtggaggagaatcctggccca

SEQ ID NO: 318 - DNA, 66 bp, Artificial Sequence
  P2A
ggatccggagctaccaacttctctctgctgaaacaggcaggcgatgtggaggaaaatcctgggcca

SEQ ID NO: 319 - DNA, 66 bp, Artificial Sequence
  P2A
gggagtggagcaacaaacttttcactgctgaagcaggccggcgatgtggaggaaaatcctgggcca

SEQ ID NO: 320 - DNA, 66 bp, Artificial Sequence
  P2A
gggtccggagccacaaatttttctctgctgaaacaggctggcgatgtggaggaaaaccctgggcca

SEQ ID NO: 321 - DNA, 66 bp, Artificial Sequence
  P2A
ggaagcggcgcaacaaacttttccctgctgaaacaggccggagatgtggaggaaaatcctggccca

SEQ ID NO: 322 - DNA, 66 bp, Artificial Sequence
  P2A
ggaagcggcgccacaaacttctcactgctgaaacaggccggcgacgtggaggagaatcctggccca

SEQ ID NO: 323 - DNA, 66 bp, Artificial Sequence
  P2A
ggcagcggcgccaccaacttcagcctgcttaaacaggcaggcgacgtggaggagaatcctggccca

SEQ ID NO: 324 - DNA, 66 bp, Artificial Sequence
  P2A
ggctctggcgccaccaactttagcctgctgaagcaggccggcgatgtggaggagaatcctggccca

SEQ ID NO: 325 - DNA, 66 bp, Artificial Sequence
  P2A
ggaagcggcgccacaaacttctcactgctgaaacaggctggcgacgtggaggagaatcctggccca

SEQ ID NO: 326 - DNA, 66 bp, Artificial Sequence
  P2A
ggcagcggcgccaccaacttcagcctgcttaaacaagctggcgacgtggaggagaatcctggccca

SEQ ID NO: 327 - protein, 21 aa, Artificial Sequence
  Signal Sequence
  ref <308>: DATABASE ACCESSION NUMBER: NCBI NG_001332.3
  ref <309>: DATABASE ENTRY DATE: 2016-08-31
MKKHLTTFLVILWLYFYRGNG

SEQ ID NO: 328 - protein, 19 aa, Homo sapiens
  Signal Sequence
  ref <308>: DATABASE ACCESSION NUMBER: NCBI NG_001333.2
  ref <309>: DATABASE ENTRY DATE: 2016-08-31
METLLGLLILWLQLQWVSS

SEQ ID NO: 329 - protein, 19 aa, Artificial Sequence
  SIgnal Sequence
MSLGLLCCGAFSLLWAGPV

SEQ ID NO: 330 - protein, 15 aa, Artificial Sequence
  Signal Sequence
MLSLLLLLLGLGSVF

SEQ ID NO: 331 - protein, 19 aa, Artificial Sequence
  Signal Sequence
MLLLLVPVLEVIFTLGGTR

SEQ ID NO: 332 - protein, 22 aa, Artificial Sequence
  Signal Sequence
MEKNPLAAPLLILWFHLDCVSS

SEQ ID NO: 333 - protein, 141 aa, Homo sapiens
  Native TCR alpha constant region
NIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 334 - protein, 141 aa, Homo sapiens
  Native TCR alpha constant region
NIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 335 - protein, 141 aa, Homo sapiens
  Native TCR alpha constant region
HIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 336 - protein, 141 aa, Homo sapiens
  Native TCR alpha constant region
YIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 337 - protein, 141 aa, Homo sapiens
  Native TCR alpha constant region
DIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 338 - protein, 142 aa, Homo sapiens
  Native TCR alpha constant region
PNIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 339 - protein, 177 aa, Homo sapiens
  Native TCR beta constant region
EDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 340 - protein, 179 aa, Homo sapiens
  Native TCR beta constant region
EDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 341 - protein, 142 aa, Homo sapiens
  Native TCR alpha constant region
PNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 342 - protein, 180 aa, Homo sapiens
  Native TCR beta constant region
TEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 343 - protein, 180 aa, Homo sapiens
  Native TCR beta constant region
LEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 344 - protein, 141 aa, Homo sapiens
  TCR alpha constant region
NIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 345 - protein, 141 aa, Homo sapiens
  TCR alpha constant region
HIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 346 - protein, 141 aa, Homo sapiens
  TCR alpha constant region
YIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 347 - protein, 141 aa, Homo sapiens; identical to SEQ ID NO: 14
  TCR alpha constant region

SEQ ID NO: 348 - protein, 141 aa, Homo sapiens
  TCR alpha constant region
DIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 349 - protein, 19 aa, Artificial Sequence
  Signal Sequence
MGIRLLCRVAFCFLAVGLV

SEQ ID NO: 350 - protein, 179 aa, Homo sapiens
  TCR beta constant region
EDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 351 - protein, 180 aa, Homo sapiens
  TCR beta constant region
TEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 352 - protein, 180 aa, Homo sapiens
  TCR beta constant region
LEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 353 - protein, 20 aa, Artificial Sequence
  Signal sequence
MSLSSLLKVVTASLWLGPGI

SEQ ID NO: 354 - protein, 17 aa, Artificial Sequence
  Signal sequence
MKLVTSITVLLSLGIMG

SEQ ID NO: 355 - protein, 21 aa, Artificial Sequence
  Signal sequence
MGTSLLCWMALCLLGADHADT

SEQ ID NO: 356 - protein, 13 aa, Artificial Sequence
  TCR E7(11-19) alpha CDR3 consensus
  VARIANT (1)...(1): Xaa = A or G
  VARIANT (2)...(2): Xaa = A, G, P, V, or L
  VARIANT (3)...(3): Xaa =  A, K, N, Y, D, or S
  VARIANT (4)...(4): Xaa =  R, M, I, T, or G
  VARIANT (5)...(5): Xaa = N, E, L, V, or null
  VARIANT (6)...(6): Xaa =  Y, G, N, D, or null
  VARIANT (7)...(7): Xaa = S, N, G, or null
  VARIANT (8)...(8): Xaa = G, N, Y, or null
  VARIANT (9)...(9): Xaa = D, F, G, N, or null
  VARIANT (10)...(10): Xaa = A, N, Q, or Y
  VARIANT (11)...(11): Xaa =  K, R, or N
  VARIANT (12)...(12): Xaa = F, L, or Y
  VARIANT (13)...(13): Xaa = I, M, S, T, V, or Y
XXXXXXXXXXXXX

SEQ ID NO: 357 - protein, 13 aa, Artificial Sequence
  TCR E7(11-19) beta CDR3 consensus
  VARIANT (1)...(1): Xaa = A or S
  VARIANT (2)...(2): Xaa = A, I, S, or Y
  VARIANT (3)...(3): Xaa = S, T, or R
  VARIANT (4)...(4): Xaa = G, K, R, L, P, S, or Q
  VARIANT (5)...(5): Xaa = D, G, T, or W
  VARIANT (6)...(6): Xaa = A, E, F, R, S, Q, T or V
  VARIANT (7)...(7): Xaa = A, R, G, Y, or null
  VARIANT (8)...(8): Xaa = G, N, S, or null
  VARIANT (9)...(9): Xaa = A, D, G, S, or Y
  VARIANT (10)...(10): Xaa = L, N, or Y
  VARIANT (11)...(11): Xaa = E or V
  VARIANT (12)...(12): Xaa =  L or Q
  VARIANT (13)...(13): Xaa = F, Y, or T
XXXXXXXXXXXXX

SEQ ID NO: 358 - DNA, 537 bp, Homo sapiens
  TCR beta constant region
gaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

SEQ ID NO: 359 - protein, 295 aa, Artificial Sequence
  Beta with human constant sequence
GAVVSQHPSWVICKSGTSVKIECRSLDFQATTMFWYRQFPKQSLMLMATSNEGSKATYEQGVEKDKFLINHASLTLSTLTVTSAHPEDSSFYICSARSWRGGLEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 360 - protein, 309 aa, Artificial Sequence
  Beta with human constant sequence and signal peptide
MLLLLLLLGPGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSARSWRGGLEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 361 - DNA, 927 bp, Artificial Sequence
  beta with human constant sequence and signal peptide
atgctgctgcttctgctgcttctggggccaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagatcttggcgggggggccttgagcagttcttcgggccagggacacggctcaccgtgctagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

SEQ ID NO: 362 - protein, 600 aa, Artificial Sequence
  TCR Full sequence with human constant
MLLLLLLLGPGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSARSWRGGLEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 363 - DNA, 1800 bp, Artificial Sequence
  TCR Full sequence with human constant
atgctgctgcttctgctgcttctggggccaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagatcttggcgggggggccttgagcagttcttcgggccagggacacggctcaccgtgctagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcaggagctcgcaacttcaacaaattttactttggatctgggaccaaactcaatgtaaaaccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagc

SEQ ID NO: 364 - DNA, 1893 bp, Artificial Sequence
  TCR 56 Native full sequence with human constant (nt)
atggccaactctgctatggacaccagagtactctgctgtgcggtcatctgtcttctgggggcaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccagacgaaagcagggatagcaatcagccccagcattttggtgatgggactcgactctccatcctagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatggctcaggaactgggaatgcagtgccaggctcgtggtatcctgcagcagatgtggggagttttccttctttatgtttccatgaagatgggaggcactacaggacaaaacattgaccagcccactgagatgacagctacggaaggtgccattgtccagatcaactgcacgtaccagacatctgggttcaacgggctgttctggtaccagcaacatgctggcgaagcacccacatttctgtcttacaatgttctggatggtttggaggagaaaggtcgtttttcttcattccttagtcggtctaaagggtacagttacctccttttgaaggagctccagatgaaagactctgcctcttacctctgtgctgtgagagattggggatatggtggtgctacaaacaagctcatctttggaactggcactctgcttgctgtccagccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 365 - DNA, 1803 bp, Artificial Sequence
  TCR 57 Full sequence with human constant (nt)
atgctgctgcttctgctgcttctggggccaggctccgggcttggtgctgtcgtctctcaacatccgagctgggttatctgtaagagtggaacctctgtgaagatcgagtgccgttccctggactttcaagccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagatcttggcgggggggccttgagcagttcttcgggccagggacacggctcaccgtgctagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtccacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggtcctgaaattctccgtgtccattctttggattcagttggcatgggtcagcacccagctgctggagcagagccctcagtttctaagcatccaagagggagaaaatctcactgtgtactgcaactcctcaagtgttttttcctccttacaatggtatcgacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgccggagctcgcaacttcaacaaattttactttggatctgggaccaaactcaatgtgaaaccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaaatgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttcggattctgcttctcaaagttgcggggttcaatctcctgatgacgttgcggctttggagcagctaa

SEQ ID NO: 366 - DNA, 407 bp, Artificial Sequence
  TCR alpha constant region, Homo sapiens (nt)
ccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 367 - DNA, 407 bp, Artificial Sequence
  TCR alpha constant region, Homo sapiens (nt)
ccgcggtatatcaactgcgcgactcaaaatcatccgataagagtgtctgtttgtttactgacttcgacagtcaaactaatgtctctcagagcaaagattccgatgtctacatcactgacaaatgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttcggattctgcttctcaaagttgcggggttcaatctcctgatgacgttgcggctttggagcagctaa

SEQ ID NO: 368 - DNA, 66 bp, Artificial Sequence; identical to SEQ ID NO: 325
  P2A  Artificial  (nt)

SEQ ID NO: 369 - protein, 296 aa, Artificial Sequence
  TCR 56 beta with human constant sequence (aa)
NAGVMQNPRHLVRRRGQEARLRCSPMKGHSHVYWYRQLPEEGLKFMVYLQKENIIDESGMPKERFSAEFPKEGPSILRIQQVVRGDSAAYFCASSPDESRDSNQPQHFGDGTRLSILEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 370 - protein, 292 aa, Artificial Sequence
  TCR 58  beta with human constant sequence (aa)
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 371 - protein, 292 aa, Artificial Sequence
  TCR 59  beta with human constant sequence (aa)
EPEVTQTPSHQVTQMGQEVILRCVPISNHLYFYWYRQILGQKVEFLVSFYNNEISEKSEIFDDQFSVERPDGSNFTLKIRSTKLEDSAMYFCAYSGRASYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 372 - protein, 292 aa, Artificial Sequence
  TCR 60  beta with human constant sequence (aa)
EPEVTQTPSHQVTQMGQEVILRCVPISNHLYFYWYRQILGQKVEFLVSFYNNEISEKSEIFDDQFSVERPDGSNFTLKIRSTKLEDSAMYFCAISRTVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 373 - protein, 292 aa, Artificial Sequence
  TCR 61  beta with human constant sequence (aa)
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTKRFSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 374 - protein, 296 aa, Artificial Sequence
  TCR 62  beta with human constant sequence (aa)
EAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDTRGSSYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 375 - protein, 295 aa, Artificial Sequence
  TCR 63  beta with human constant sequence (aa)
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASRPRQGYNDNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 376 - protein, 293 aa, Artificial Sequence
  TCR 64 beta with human constant sequence (aa)
DTAVSQTPKYLVTQMGNDKSIKCEQNLGHDTMYWYKQDSKKFLKIMFSYNNKELIINETVPNRFSPKSPDKAHLNLHINSLELGDSAVYFCASSQGEAGANVLTFGAGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 377 - protein, 294 aa, Artificial Sequence
  TCR 65  beta with human constant sequence (aa)
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRRNTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 378 - protein, 320 aa, Artificial Sequence
  TCR 56 beta with human constant sequence and signal peptide (aa)
MANSAMDTRVLCCAVICLLGAGLSNAGVMQNPRHLVRRRGQEARLRCSPMKGHSHVYWYRQLPEEGLKFMVYLQKENIIDESGMPKERFSAEFPKEGPSILRIQQVVRGDSAAYFCASSPDESRDSNQPQHFGDGTRLSILEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 379 - protein, 311 aa, Artificial Sequence
  TCR 58 beta with human constant sequence and signal peptide (aa)
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 380 - protein, 311 aa, Artificial Sequence
  TCR 59 beta with human constant sequence and signal peptide (aa)
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAYSGRASYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 381 - protein, 311 aa, Artificial Sequence
  TCR 60 beta with human constant sequence and signal peptide (aa)
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAISRTVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 382 - protein, 311 aa, Artificial Sequence
  TCR 61 beta with human constant sequence and signal peptide (aa)
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTKRFSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 383 - protein, 315 aa, Artificial Sequence
  TCR 62 beta with human constant sequence and signal peptide (aa)
MGTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLDTRGSSYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 384 - protein, 314 aa, Artificial Sequence
  TCR 63 beta with human constant sequence and signal peptide (aa)
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASRPRQGYNDNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 385 - protein, 312 aa, Artificial Sequence
  TCR 64 beta with human constant sequence and signal peptide (aa)
MGCRLLCCVVFCLLQAGPLDTAVSQTPKYLVTQMGNDKSIKCEQNLGHDTMYWYKQDSKKFLKIMFSYNNKELIINETVPNRFSPKSPDKAHLNLHINSLELGDSAVYFCASSQGEAGANVLTFGAGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 386 - protein, 313 aa, Artificial Sequence
  TCR 65 beta with human constant sequence and signal peptide (aa)
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRRNTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 387 - DNA, 1890 bp, Artificial Sequence
  TCR 56 Native full sequence with human constant (nt)
atggccaactctgctatggacaccagagtactctgctgtgcggtcatctgtcttctgggggcaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccagacgaaagcagggatagcaatcagccccagcattttggtgatgggactcgactctccatcctagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctccggagcaaccaatttcagcctgctgaagcaggccggcgatgtggaggagaatcctggcccaatggctcaggaactgggaatgcagtgccaggctcgtggtatcctgcagcagatgtggggagttttccttctttatgtttccatgaagatgggaggcactacaggacaaaacattgaccagcccactgagatgacagctacggaaggtgccattgtccagatcaactgcacgtaccagacatctgggttcaacgggctgttctggtaccagcaacatgctggcgaagcacccacatttctgtcttacaatgttctggatggtttggaggagaaaggtcgtttttcttcattccttagtcggtctaaagggtacagttacctccttttgaaggagctccagatgaaagactctgcctcttacctctgtgctgtgagagattggggatatggtggtgctacaaacaagctcatctttggaactggcactctgcttgctgtccagccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 388 - DNA, 1899 bp, Artificial Sequence
  TCR 56 Codon-optimized full sequence with human constant (nt)
atgggacccatggccaatagcgccatggataccagagtgctgtgctgcgccgtgatctgtctgcttggagccggactgtctaatgccggcgtgatgcagaaccccagacacctcgttcggagaagaggccaagaggccagactgagatgcagccctatgaagggccacagccacgtgtactggtacagacagctgcctgaagagggcctgaagttcatggtgtacctgcagaaagagaacatcatcgacgagagcggcatgcccaaagagcggttctctgccgagtttcccaaagagggccccagcatcctgagaatccagcaggttgtgcggggagatagcgccgcctacttttgtgccagctctcccgatgagagccgggactctaatcagcctcagcactttggcgacggcaccaggctgtctattctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctccggagcaaccaatttcagcctgctgaagcaggccggcgatgtggaggagaatcctggcccaatggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgcgccgttagagattggggatacggcggagccaccaacaagctgatctttggcacaggcacactgctggccgtgcagcctaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 389 - DNA, 1797 bp, Artificial Sequence
  TCR 57 Native full sequence with human constant (nt)
atgctgctgcttctgctgcttctggggccaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagatcttggcgggggggccttgagcagttcttcgggccagggacacggctcaccgtgctagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctccggagcaaccaatttcagcctgctgaagcaggccggcgatgtggaggagaatcctggcccaatggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcaggagctcgcaacttcaacaaattttactttggatctgggaccaaactcaatgtaaaaccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 390 - DNA, 1797 bp, Artificial Sequence
  TCR 57 Codon-optimized full sequence with human constant (nt)
atgctcctgctgcttctgctcctcgggcccggcagcggtctcggcgccgtcgtgtcgcagcacccgtcgtgggtgatttgcaagagcggaacgagcgtgaagatcgagtgccgctcgctcgacttccaggccacaaccatgttctggtaccgccagtttcccaagcagagcctcatgctgatggccacaagcaatgaaggcagcaaggccacttatgaacagggcgtggagaaggacaagtttctgatcaaccacgcctccctgaccctgtccaccctcactgtgaccagcgcccaccctgaggacagcagcttctacatctgcagcgcccgcagctggaggggcggcctggagcagttcttcggccctggcacccggctgacagtgctggaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctccggagcaaccaatttcagcctgctgaagcaggccggcgatgtggaggagaatcctggcccaatggtgctgaagttttctgtgagcatcctgtggattcagctggcctgggtgtccacccagctcctggagcagagcccccagttcctgtccatccaggagggcgagaacctgaccgtgtactgcaacagctcttctgtcttttcatcactgcagtggtatagacaagaaccgggtgaaggtccagttctgctggtgaccgtcgtcaccggcggcgaggtgaagaagctaaagcgcctgacgttccagttcggagacgcgcggaaggactcgtcgctgcacatcaccgccgcccagcccggcgacaccggcctgtacctgtgcgctggcgcgcgcaacttcaacaagttctacttcggcagcggcaccaagctgaacgtgaaaccgaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 391 - DNA, 1818 bp, Artificial Sequence
  TCR 58 Native full sequence with human constant (nt)
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccccccgaagctcctacgagcagtacttcgggccgggcaccaggctcacggtcacagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctccggagcaaccaatttcagcctgctgaagcaggccggcgatgtggaggagaatcctggcccaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacagggataactatggtcagaattttgtctttggtcccggaaccagattgtccgtgctgcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 392 - DNA, 1824 bp, Artificial Sequence
  TCR 59 Native full sequence with human constant (nt)
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgcctattcgggcagggcctcctacgagcagtacttcgggccgggcaccaggctcacggtcacagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctccggagcaaccaatttcagcctgctgaagcaggccggcgatgtggaggagaatcctggcccaatgaagagggagagggagatgctactcatcacatcaatgttggtcttatggatgcaattgtcacaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcacccaagcgggaatatggaaacaaactggtctttggcgcaggaaccattctgagagtcaagtccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 393 - DNA, 1830 bp, Artificial Sequence
  TCR 60 Native full sequence with human constant (nt)
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatcagtcggacagtctcctacgagcagtacttcgggccgggcaccaggctcacggtcacagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctccggagcaaccaatttcagcctgctgaagcaggccggcgatgtggaggagaatcctggcccaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatgttggggagtggaggtagcaactataaactgacatttggaaaaggaactctcttaaccgtgaatccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 394 - DNA, 1821 bp, Artificial Sequence
  TCR 61 Native full sequence with human constant (nt)
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccaaacgttttagctacgagcagtacttcgggccgggcaccaggctcacggtcacagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctccggagcaaccaatttcagcctgctgaagcaggccggcgatgtggaggagaatcctggcccaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatagagaataacaatgccagactcatgtttggagatggaactcagctggtggtgaagcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 395 - DNA, 1824 bp, Artificial Sequence
  TCR 62 Native full sequence with human constant (nt)
atgggcaccaggctcctctgctgggcggccctctgtctcctgggagcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcttagatacccggggctcctcctacaatgagcagttcttcgggccagggacacggctcaccgtgctagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctccggagcaaccaatttcagcctgctgaagcaggccggcgatgtggaggagaatcctggcccaatgacacgagttagcttgctgtgggcagtcgtggtctccacctgtcttgaatccggcatggcccagacagtcactcagtctcaaccagagatgtctgtgcaggaggcagagactgtgaccctgagttgcacatatgacaccagtgagaataattattatttgttctggtacaagcagcctcccagcaggcagatgattctcgttattcgccaagaagcttataagcaacagaatgcaacggagaatcgtttctctgtgaacttccagaaagcagccaaatccttcagtctcaagatctcagactcacagctgggggacactgcgatgtatttctgtgctctctatacctacaaatacatctttggaacaggcaccaggctgaaggttttagcaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 396 - DNA, 1818 bp, Artificial Sequence
  TCR 63 Native full sequence with human constant (nt)
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagaccaagacaggggtataatgacaatgagcagttcttcgggccagggacacggctcaccgtgctagaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctccggagcaaccaatttcagcctgctgaagcaggccggcgatgtggaggagaatcctggcccaatggagactgttctgcacgtactcctagggatattggggttccaagcagcctgggtcagtagccaagaactggagcagagtcctcagtccttgatcgtccaagagggaaagaatctcaccataaactgcacgtcatcaaagacgttatatggcttatactggtataagcaaaagtatggtgaaggtcttatcttcttgatgatgctacagaaaggtggggaagagaaaagtcatgaaaagataactgccaagttggatgagaaaaagcagcaaagttccctgcatatcacagcctcccagcccagccatgcaggcatctacctctgtggagcagacatagacgactacaagctcagctttggagccggaaccacagtaactgtaagagcaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 397 - DNA, 1836 bp, Artificial Sequence
  TCR 64 Native full sequence with human constant (nt)
atgggctgcaggctcctctgctgtgtggtcttctgcctcctccaagcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccagggggaagctggggccaacgtcctgactttcggggccggcagcaggctgaccgtgctggaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctccggagcaaccaatttcagcctgctgaagcaggccggcgatgtggaggagaatcctggcccaatgaacatgctgactgccagcctgttgagggcagtcatagcctccatctgtgttgtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgagtggggtcgataactatggtcagaattttgtctttggtcccggaaccagattgtccgtgctgcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 398 - DNA, 1827 bp, Artificial Sequence
  TCR 65 Native full sequence with human constant (nt)
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggacggcgaaacaccggggagctgttttttggagaaggctctaggctgaccgtactggaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctccggagcaaccaatttcagcctgctgaagcaggccggcgatgtggaggagaatcctggcccaatggagaaaatgttggagtgtgcattcatagtcttgtggcttcagcttggctggttgagtggagaagaccaggtgacgcagagtcccgaggccctgagactccaggagggagagagtagcagtcttaactgcagttacacagtcagcggtttaagagggctgttctggtataggcaagatcctgggaaaggccctgaattcctcttcaccctgtattcagctggggaagaaaaggagaaagaaaggctaaaagccacattaacaaagaaggaaagctttctgcacatcacagcccctaaacctgaagactcagccacttatctctgtgctgtgcaggcagaaagaggctcaaccctggggaggctatactttggaagaggaactcagttgactgtctggcctaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 399 - DNA, 1902 bp, Artificial Sequence
  TCR 56 Codon-optimized full sequence with human constant (nt)
atgggacccatggccaatagcgccatggataccagagtgctgtgctgcgccgtgatctgtctgcttggagccggactgtctaatgccggcgtgatgcagaaccccagacacctcgttcggagaagaggccaagaggccagactgagatgcagccctatgaagggccacagccacgtgtactggtacagacagctgcctgaagagggcctgaagttcatggtgtacctgcagaaagagaacatcatcgacgagagcggcatgcccaaagagcggttctctgccgagtttcccaaagagggccccagcatcctgagaatccagcaggttgtgcggggagatagcgccgcctacttttgtgccagctctcccgatgagagccgggactctaatcagcctcagcactttggcgacggcaccaggctgtctattctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttctaaggctccggagcaaccaatttcagcctgctgaagcaggccggcgatgtggaggagaatcctggcccaatggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgcgccgttagagattggggatacggcggagccaccaacaagctgatctttggcacaggcacactgctggccgtgcagcctaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 400 - DNA, 1896 bp, Artificial Sequence
  TCR 56 Native full sequence with human constant (nt)
atggccaactctgctatggacaccagagtactctgctgtgcggtcatctgtcttctgggggcaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccagacgaaagcagggatagcaatcagccccagcattttggtgatgggactcgactctccatcctagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggctcaggaactgggaatgcagtgccaggctcgtggtatcctgcagcagatgtggggagttttccttctttatgtttccatgaagatgggaggcactacaggacaaaacattgaccagcccactgagatgacagctacggaaggtgccattgtccagatcaactgcacgtaccagacatctgggttcaacgggctgttctggtaccagcaacatgctggcgaagcacccacatttctgtcttacaatgttctggatggtttggaggagaaaggtcgtttttcttcattccttagtcggtctaaagggtacagttacctccttttgaaggagctccagatgaaagactctgcctcttacctctgtgctgtgagagattggggatatggtggtgctacaaacaagctcatctttggaactggcactctgcttgctgtccagccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 401 - DNA, 1905 bp, Artificial Sequence
  TCR 56 Codon-optimized full sequence with human constant (nt)
atgggacccatggccaatagcgccatggataccagagtgctgtgctgcgccgtgatctgtctgcttggagccggactgtctaatgccggcgtgatgcagaaccccagacacctcgttcggagaagaggccaagaggccagactgagatgcagccctatgaagggccacagccacgtgtactggtacagacagctgcctgaagagggcctgaagttcatggtgtacctgcagaaagagaacatcatcgacgagagcggcatgcccaaagagcggttctctgccgagtttcccaaagagggccccagcatcctgagaatccagcaggttgtgcggggagatagcgccgcctacttttgtgccagctctcccgatgagagccgggactctaatcagcctcagcactttggcgacggcaccaggctgtctattctcgaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgcgccgttagagattggggatacggcggagccaccaacaagctgatctttggcacaggcacactgctggccgtgcagcctaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 402 - DNA, 1803 bp, Artificial Sequence
  TCR 57 Codon-optimized full sequence with human constant (nt)
atgctcctgctgcttctgctcctcgggcccggcagcggtctcggcgccgtcgtgtcgcagcacccgtcgtgggtgatttgcaagagcggaacgagcgtgaagatcgagtgccgctcgctcgacttccaggccacaaccatgttctggtaccgccagtttcccaagcagagcctcatgctgatggccacaagcaatgaaggcagcaaggccacttatgaacagggcgtggagaaggacaagtttctgatcaaccacgcctccctgaccctgtccaccctcactgtgaccagcgcccaccctgaggacagcagcttctacatctgcagcgcccgcagctggaggggcggcctggagcagttcttcggccctggcacccggctgacagtgctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggtgctgaagttttctgtgagcatcctgtggattcagctggcctgggtgtccacccagctcctggagcagagcccccagttcctgtccatccaggagggcgagaacctgaccgtgtactgcaacagctcttctgtcttttcatcactgcagtggtatagacaagaaccgggtgaaggtccagttctgctggtgaccgtcgtcaccggcggcgaggtgaagaagctaaagcgcctgacgttccagttcggagacgcgcggaaggactcgtcgctgcacatcaccgccgcccagcccggcgacaccggcctgtacctgtgcgctggcgcgcgcaacttcaacaagttctacttcggcagcggcaccaagctgaacgtgaaaccgaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 403 - DNA, 1824 bp, Artificial Sequence
  TCR 58 Native full sequence with human constant (nt)
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccccccgaagctcctacgagcagtacttcgggccgggcaccaggctcacggtcacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacagggataactatggtcagaattttgtctttggtcccggaaccagattgtccgtgctgcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 404 - DNA, 1824 bp, Artificial Sequence
  TCR 59 Native full sequence with human constant (nt)
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgcctattcgggcagggcctcctacgagcagtacttcgggccgggcaccaggctcacggtcacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacagggataactatggtcagaattttgtctttggtcccggaaccagattgtccgtgctgcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 405 - DNA, 1836 bp, Artificial Sequence
  TCR 60 Native full sequence with human constant (nt)
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatcagtcggacagtctcctacgagcagtacttcgggccgggcaccaggctcacggtcacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatgttggggagtggaggtagcaactataaactgacatttggaaaaggaactctcttaaccgtgaatccaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 406 - DNA, 1827 bp, Artificial Sequence
  TCR 61 Native full sequence with human constant (nt)
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccaaacgttttagctacgagcagtacttcgggccgggcaccaggctcacggtcacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatagagaataacaatgccagactcatgtttggagatggaactcagctggtggtgaagcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 407 - DNA, 1830 bp, Artificial Sequence
  TCR 62 Native full sequence with human constant (nt)
atgggcaccaggctcctctgctgggcggccctctgtctcctgggagcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcttagatacccggggctcctcctacaatgagcagttcttcgggccagggacacggctcaccgtgctagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgacacgagttagcttgctgtgggcagtcgtggtctccacctgtcttgaatccggcatggcccagacagtcactcagtctcaaccagagatgtctgtgcaggaggcagagactgtgaccctgagttgcacatatgacaccagtgagaataattattatttgttctggtacaagcagcctcccagcaggcagatgattctcgttattcgccaagaagcttataagcaacagaatgcaacggagaatcgtttctctgtgaacttccagaaagcagccaaatccttcagtctcaagatctcagactcacagctgggggacactgcgatgtatttctgtgctctctatacctacaaatacatctttggaacaggcaccaggctgaaggttttagcaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 408 - DNA, 1824 bp, Artificial Sequence
  TCR 63 Native full sequence with human constant (nt)
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagaccaagacaggggtataatgacaatgagcagttcttcgggccagggacacggctcaccgtgctagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggagactgttctgcacgtactcctagggatattggggttccaagcagcctgggtcagtagccaagaactggagcagagtcctcagtccttgatcgtccaagagggaaagaatctcaccataaactgcacgtcatcaaagacgttatatggcttatactggtataagcaaaagtatggtgaaggtcttatcttcttgatgatgctacagaaaggtggggaagagaaaagtcatgaaaagataactgccaagttggatgagaaaaagcagcaaagttccctgcatatcacagcctcccagcccagccatgcaggcatctacctctgtggagcagacatagacgactacaagctcagctttggagccggaaccacagtaactgtaagagcaaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 409 - DNA, 1842 bp, Artificial Sequence
  TCR 64 Native full sequence with human constant (nt)
atgggctgcaggctcctctgctgtgtggtcttctgcctcctccaagcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccagggggaagctggggccaacgtcctgactttcggggccggcagcaggctgaccgtgctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgaacatgctgactgccagcctgttgagggcagtcatagcctccatctgtgttgtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgagtggggtcgataactatggtcagaattttgtctttggtcccggaaccagattgtccgtgctgcccaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 410 - DNA, 1833 bp, Artificial Sequence
  TCR 65 Native full sequence with human constant (nt)
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggacggcgaaacaccggggagctgttttttggagaaggctctaggctgaccgtactggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggagaaaatgttggagtgtgcattcatagtcttgtggcttcagcttggctggttgagtggagaagaccaggtgacgcagagtcccgaggccctgagactccaggagggagagagtagcagtcttaactgcagttacacagtcagcggtttaagagggctgttctggtataggcaagatcctgggaaaggccctgaattcctcttcaccctgtattcagctggggaagaaaaggagaaagaaaggctaaaagccacattaacaaagaaggaaagctttctgcacatcacagcccctaaacctgaagactcagccacttatctctgtgctgtgcaggcagaaagaggctcaaccctggggaggctatactttggaagaggaactcagttgactgtctggcctaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 411 - DNA, 960 bp, Artificial Sequence
  TCR 56 Native full sequence with human constant (nt)
atggccaactctgctatggacaccagagtactctgctgtgcggtcatctgtcttctgggggcaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccagacgaaagcagggatagcaatcagccccagcattttggtgatgggactcgactctccatcctagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

SEQ ID NO: 412 - DNA, 969 bp, Artificial Sequence
  TCR 56 Codon-optimized full sequence with human constant (nt)
atgggacccatggccaatagcgccatggataccagagtgctgtgctgcgccgtgatctgtctgcttggagccggactgtctaatgccggcgtgatgcagaaccccagacacctcgttcggagaagaggccaagaggccagactgagatgcagccctatgaagggccacagccacgtgtactggtacagacagctgcctgaagagggcctgaagttcatggtgtacctgcagaaagagaacatcatcgacgagagcggcatgcccaaagagcggttctctgccgagtttcccaaagagggccccagcatcctgagaatccagcaggttgtgcggggagatagcgccgcctacttttgtgccagctctcccgatgagagccgggactctaatcagcctcagcactttggcgacggcaccaggctgtctattctcgaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

SEQ ID NO: 413 - DNA, 927 bp, Artificial Sequence
  TCR 57 Codon-optimized full sequence with human constant (nt)
atgctcctgctgcttctgctcctcgggcccggcagcggtctcggcgccgtcgtgtcgcagcacccgtcgtgggtgatttgcaagagcggaacgagcgtgaagatcgagtgccgctcgctcgacttccaggccacaaccatgttctggtaccgccagtttcccaagcagagcctcatgctgatggccacaagcaatgaaggcagcaaggccacttatgaacagggcgtggagaaggacaagtttctgatcaaccacgcctccctgaccctgtccaccctcactgtgaccagcgcccaccctgaggacagcagcttctacatctgcagcgcccgcagctggaggggcggcctggagcagttcttcggccctggcacccggctgacagtgctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

SEQ ID NO: 414 - DNA, 933 bp, Artificial Sequence
  TCR 58 Native full sequence with human constant (nt)
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccccccgaagctcctacgagcagtacttcgggccgggcaccaggctcacggtcacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

SEQ ID NO: 415 - DNA, 933 bp, Artificial Sequence
  TCR 59 Native full sequence with human constant (nt)
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgcctattcgggcagggcctcctacgagcagtacttcgggccgggcaccaggctcacggtcacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

SEQ ID NO: 416 - DNA, 933 bp, Artificial Sequence
  TCR 60 Native full sequence with human constant (nt)
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatcagtcggacagtctcctacgagcagtacttcgggccgggcaccaggctcacggtcacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

SEQ ID NO: 417 - DNA, 933 bp, Artificial Sequence
  TCR 61 Native full sequence with human constant (nt)
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccaaacgttttagctacgagcagtacttcgggccgggcaccaggctcacggtcacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

SEQ ID NO: 418 - DNA, 945 bp, Artificial Sequence
  TCR 62 Native full sequence with human constant (nt)
atgggcaccaggctcctctgctgggcggccctctgtctcctgggagcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcttagatacccggggctcctcctacaatgagcagttcttcgggccagggacacggctcaccgtgctagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

SEQ ID NO: 419 - DNA, 942 bp, Artificial Sequence
  TCR 63 Native full sequence with human constant (nt)
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagaccaagacaggggtataatgacaatgagcagttcttcgggccagggacacggctcaccgtgctagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

SEQ ID NO: 420 - DNA, 870 bp, Artificial Sequence
  TCR 56 Alpha Codon-Optimized with Codon Optimized Human Constant (nt)
atggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgcgccgttagagattggggatacggcggagccaccaacaagctgatctttggcacaggcacactgctggccgtgcagcctaatatccagaatccggaccccgcggtatatcaactgcgcgactcaaaatcatccgataagagtgtctgtttgtttactgacttcgacagtcaaactaatgtctctcagagcaaagattccgatgtctacatcactgacaagtgcgttctggatatgcggagcatggattttaagtccaactccgccgtagcctggtccaacaagtcagactttgcctgtgcaaatgctttcaacaactcaattatccctgaggacactttctttccttcaccggagtcctcatgcgatgttaaactggtcgaaaaatcttttgagacggatacgaacctcaacttccaaaatttgagcgttattggctttaggattctgcttctcaaggttgcggggttcaatctcctgatgacgttgcggctttggagcagctaa

SEQ ID NO: 421 - DNA, 858 bp, Artificial Sequence
  TCR 56 Alpha Codon-Optimized with Codon Optimized Mouse Constant (nt)
atggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgcgccgttagagattggggatacggcggagccaccaacaagctgatctttggcacaggcacactgctggccgtgcagcctaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 422 - DNA, 1878 bp, Artificial Sequence
  TCR 56 Codon-optimized full sequence with mouse constant (nt)
atgggacccatggccaatagcgccatggataccagagtgctgtgctgcgccgtgatctgtctgcttggagccggactgtctaatgccggcgtgatgcagaaccccagacacctcgttcggagaagaggccaagaggccagactgagatgcagccctatgaagggccacagccacgtgtactggtacagacagctgcctgaagagggcctgaagttcatggtgtacctgcagaaagagaacatcatcgacgagagcggcatgcccaaagagcggttctctgccgagtttcccaaagagggccccagcatcctgagaatccagcaggttgtgcggggagatagcgccgcctacttttgtgccagctctcccgatgagagccgggactctaatcagcctcagcactttggcgacggcaccaggctgtctattctcgaggacctgcgcaatgtgaccccccctaaggtgtccctgtttgagccctctaaggccgagatcgccaacaagcagaaggccaccctggtgtgcctggccagaggcttcttccctgatcacgtggagctgagctggtgggtgaatggcaaggaggtgcactccggcgtgtgcaccgacccacaggcctacaaggagtccaactactcttattgtctgtcctctaggctgcgcgtgagcgccacattctggcacaaccctcggaatcacttcagatgccaggtgcagtttcacggcctgagcgaggaggataagtggccagagggctccccaaagcccgtgacccagaatatctctgccgaggcatggggcagggccgactgtggaatcacctccgcctcttatcagcagggcgtgctgtccgccacaatcctgtacgagatcctgctgggcaaggccaccctgtatgccgtgctggtgtccacactggtggtcatggccatggtgaagcgcaagaacagctaaggctccggagcaaccaatttcagcctgctgaagcaggccggcgatgtggaggagaatcctggcccaatggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgcgccgttagagattggggatacggcggagccaccaacaagctgatctttggcacaggcacactgctggccgtgcagcctaatatccagaatccggagcctgccgtgtaccagctgaaggacccacggagccaggatagcaccctgtgcctgttcaccgactttgattctcagatcaacgtgcccaagaccatggagagcggcaccttcatcacagacaagtgcgtgctggatatgaaggccatggacagcaagtccaacggcgccatcgcctggtccaatcagacatctttcacctgccaggatatctttaaggagacaaatgccacctatccttcctctgacgtgccatgtgatgccaccctgacagagaagagcttcgagaccgacatgaacctgaattttcagaatctgctcgtgattgtcctgagaatcctgctgctgaaggtggccggctttaacctgctgatgaccctgaggctgtggagctcctga

SEQ ID NO: 423 - DNA, 936 bp, Artificial Sequence
  TCR 64 Native full sequence with human constant (nt)
atgggctgcaggctcctctgctgtgtggtcttctgcctcctccaagcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccagggggaagctggggccaacgtcctgactttcggggccggcagcaggctgaccgtgctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

SEQ ID NO: 424 - DNA, 939 bp, Artificial Sequence
  TCR 65 Native full sequence with human constant (nt)
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggacggcgaaacaccggggagctgttttttggagaaggctctaggctgaccgtactggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggc

What is claimed:

1. A recombinant T cell receptor (TCR) or antigen-binding fragment thereof that binds to or recognizes a peptide epitope of human papillomavirus (HPV) 16 E7 in the context of an MHC molecule, comprising an alpha chain comprising a variable alpha (Vα) region and a beta chain comprising a variable beta (Vβ) region, wherein
the Vα region comprises a complementarity determining region 1 (CDR-1), a complementarity determining region 2 (CDR-2), and a complementarity determining region 3 (CDR-3), comprising the amino acid sequences of SEQ ID NOs: 48, 49, and 50, respectively, and the Vβ region comprises a CDR-1, a CDR-2, and a CDR-3, comprising the amino acid sequences of SEQ ID NOs: 61, 62, and 63, respectively.

2. The T cell receptor (TCR) or antigen-binding fragment thereof of claim 1, wherein
the Vα region comprises the amino acid sequence set forth in SEQ ID NO: 47 or an amino acid sequence that has at least 90% sequence identity thereto, and the Vβ region comprises the amino acid sequence set forth in SEQ ID NO: 60, or an amino acid sequence that has at least 90% sequence identity thereto.

3. The TCR or antigen-binding fragment thereof of claim 1, wherein the peptide epitope is or comprises E7(11-19) YMLDLQPET (SEQ ID NO: 271).

4. The TCR or antigen-binding fragment thereof of claim 1, wherein
the Vα and Vβ regions comprise the amino acid sequences of SEQ ID NOs: 47 and 60, respectively.

5. The TCR or antigen-binding fragment thereof of claim 1, wherein the alpha chain further comprises an alpha constant (Cα) region and the beta chain further comprises a beta constant (Cβ) region.

6. The TCR or antigen-binding fragment thereof of claim 5, wherein the Cα and Cβ regions are mouse constant regions.

7. The TCR or antigen-binding fragment thereof of claim 5, wherein the Cα and Cβ regions are human constant regions.

8. The TCR or antigen-binding fragment thereof of claim 5, wherein the Cα and/or Cβ regions comprise one or more amino acid replacements to introduce one or more cysteine residues capable of forming one or more non-native disulfide bridges between the alpha chain and beta chain.

9. The TCR or antigen-binding fragment thereof of claim 5, wherein
the alpha and beta chains comprise the amino acid sequences of SEQ ID NOs: 43 and 359, respectively.

10. The TCR or antigen-binding fragment thereof of claim 1, wherein the antigen-specificity is at least partially CD8-independent.

11. A nucleic acid molecule encoding the TCR or antigen-binding fragment thereof of claim 1, or an alpha or a beta chain thereof.

12. A vector comprising the nucleic acid of claim 11.

13. An isolated engineered cell comprising the nucleic acid molecule of claim 11.

14. An isolated engineered cell, comprising the TCR or antigen-binding fragment thereof of claim 1.

15. The isolated engineered cell of claim 14, wherein the cell is a T cell.

16. A method for producing a cell expressing a recombinant TCR or antigen-binding fragment thereof, comprising introducing the vector of claim 12 into a cell.

17. A composition comprising engineered cells of claim 14.

18. The composition of claim 17, wherein the composition comprises engineered CD8+ cells and engineered CD4+ cells.

19. A method of treatment, comprising administering the composition of claim 17 to a subject having a disease or disorder associated with HPV.

20. The isolated engineered cell of claim 15, comprising a genetic disruption of a T cell receptor alpha constant (TRAC) gene and/or a T cell receptor beta constant (TRBC) gene.

21. The isolated engineered cell of claim 20, wherein the genetic disruption comprises disruption of a T cell receptor alpha constant (TRAC) gene.

22. The TCR or antigen-binding fragment thereof of claim 5, wherein the Cα region comprises the amino acid sequence of SEQ ID NO: 14, or an amino acid sequence having at least 90% sequence identity thereto; and the Cβ region comprises the amino acid sequence of SEQ ID NO: 350, or an amino acid sequence having at least 90% sequence identity thereto.

23. The TCR or antigen-binding fragment thereof of claim 5, wherein the Cα region comprises the amino acid sequence of SEQ ID NO: 14, and the Cβ region comprises the amino acid sequence of SEQ ID NO: 350.

24. The TCR or antigen-binding fragment thereof of claim 5, wherein the TCR or antigen-binding fragment thereof is encoded by a polynucleotide that encodes the amino acid sequence of SEQ ID NO: 362, or a sequence having at least 90% sequence identity thereto.

25. A nucleic acid molecule encoding the TCR or antigen-binding fragment thereof of claim 4, or an alpha or a beta chain thereof.

26. A vector comprising the nucleic acid of claim 25.

27. An isolated engineered cell comprising the nucleic acid molecule of claim 25.

28. An isolated engineered cell, comprising the TCR or antigen-binding fragment thereof of claim 4.

29. The isolated engineered cell of claim 28, wherein the cell is a T cell.

30. A method for producing a cell expressing a recombinant TCR or antigen-binding fragment thereof, comprising introducing the vector of claim 26 into a cell.

31. A composition comprising engineered cells of claim 28.

32. The composition of claim 31, wherein the composition comprises engineered CD8+ cells and engineered CD4+ cells.

33. A method of treatment, comprising administering the composition of claim 32 to a subject having a disease or disorder associated with HPV.

34. A nucleic acid molecule encoding the TCR or antigen-binding fragment thereof of claim 22, or an alpha or a beta chain thereof.

35. A vector comprising the nucleic acid of claim 34.

36. An isolated engineered cell comprising the nucleic acid molecule of claim 34.

37. An isolated engineered cell, comprising the TCR or antigen-binding fragment thereof of claim 22.

38. The isolated engineered cell of claim 37, wherein the cell is a T cell.

39. A method for producing a cell expressing a recombinant TCR or antigen-binding fragment thereof, comprising introducing the vector of claim 35 into a cell.

40. A composition comprising engineered cells of claim 37.

41. The composition of claim 40, wherein the composition comprises engineered CD8+ cells and engineered CD4+ cells.

42. A method of treatment, comprising administering the composition of claim 40 to a subject having a disease or disorder associated with HPV.

43. An isolated engineered T cell, comprising a recombinant T cell receptor (TCR) or antigen-binding fragment thereof that binds to or recognizes a peptide epitope of human papillomavirus (HPV) 16 E7 in the context of an MHC molecule,
wherein the TCR or antigen binding fragment thereof comprises an alpha chain comprising a variable alpha (Vα) region and an alpha constant (Cα) region, and a beta chain comprising a variable beta (Vβ) region and a beta constant (Cβ) region,
wherein the Vα region comprises a complementarity determining region 1 (CDR-1), a complementarity determining region 2 (CDR-2), and a complementarity determining region 3 (CDR-3), comprising the amino acid sequences of SEQ ID NOs: 48, 49, and 50, respectively, and the Vβ region comprises a CDR-1, a CDR-2, and a CDR-3, comprising the amino acid sequences of SEQ ID NOs: 61, 62, and 63, respectively; and wherein the Cα region comprises the amino acid sequence of SEQ ID NO: 14, and the Cβ region comprises the amino acid sequence of SEQ ID NO: 350.

44. The isolated engineered cell of claim 43, comprising a genetic disruption of a T cell receptor alpha constant (TRAC) gene and/or a T cell receptor beta constant (TRBC) gene.

45. The isolated engineered cell of claim 44, wherein the genetic disruption comprises disruption of a T cell receptor alpha constant (TRAC) gene.

46. A composition comprising engineered cells of claim 43.

47. The composition of claim 46, wherein the composition comprises engineered CD8+ cells and engineered CD4+ cells.

48. A method of treatment, comprising administering the composition of claim 46 to a subject having a disease or disorder associated with HPV.

49. A composition comprising engineered cells of claim 44.

50. The composition of claim 49, wherein the composition comprises engineered CD8+ cells and engineered CD4+ cells.

51. A method of treatment, comprising administering the composition of claim 49 to a subject having a disease or disorder associated with HPV.

52. An isolated engineered T cell, comprising a recombinant T cell receptor (TCR) or antigen-binding fragment thereof that binds to or recognizes a peptide epitope of human papillomavirus (HPV) 16 E7 in the context of an MHC molecule, wherein the TCR or antigen binding fragment thereof comprises an alpha chain comprising the amino acid sequence of SEQ ID NO: 43, and a beta chain comprising the amino acid sequence of SEQ ID NO: 359.

53. The isolated engineered cell of claim 52, comprising a genetic disruption of a T cell receptor alpha constant (TRAC) gene and/or a T cell receptor beta constant (TRBC) gene.

54. The isolated engineered cell of claim 53, wherein the genetic disruption comprises disruption of a T cell receptor alpha constant (TRAC) gene.

55. A composition comprising engineered cells of claim 52.

56. The composition of claim 55, wherein the composition comprises engineered CD8+ cells and engineered CD4+ cells.

57. A method of treatment, comprising administering the composition of claim 55 to a subject having a disease or disorder associated with HPV.

58. A composition comprising engineered cells of claim 53.

59. The composition of claim 58, wherein the composition comprises engineered CD8+ cells and engineered CD4+ cells.

60. A method of treatment, comprising administering the composition of claim 58 to a subject having a disease or disorder associated with HPV.

* * * * *